US007968697B2

(12) United States Patent
Sällberg

(10) Patent No.: US 7,968,697 B2
(45) Date of Patent: Jun. 28, 2011

(54) HEPATITIS C VIRUS NON-STRUCTURAL NS3/4A FUSION GENE

(75) Inventor: Matti Sällberg, Stockholm (SE)

(73) Assignee: ChronTech Pharma AB, Huddinge (SE)

( * ) Notice: Subject to any disclaimer, the term of this patent is extended or adjusted under 35 U.S.C. 154(b) by 207 days.

(21) Appl. No.: 11/915,142

(22) PCT Filed: May 24, 2006

(86) PCT No.: PCT/IB2006/002607
§ 371 (c)(1),
(2), (4) Date: May 20, 2008

(87) PCT Pub. No.: WO2007/031867
PCT Pub. Date: Mar. 22, 2007

(65) Prior Publication Data
US 2009/0215869 A1    Aug. 27, 2009

Related U.S. Application Data

(60) Provisional application No. 60/685,014, filed on May 25, 2005.

(51) Int. Cl.
C07H 21/02 (2006.01)
C07H 21/04 (2006.01)
(52) U.S. Cl. .................... 536/23.72; 536/23.1; 536/23.2
(58) Field of Classification Search ................... 536/23.1
See application file for complete search history.

(56) References Cited

U.S. PATENT DOCUMENTS

| 4,215,051 A | 7/1980 | Schroeder et al. |
| 4,376,110 A | 3/1983 | David et al. |
| 4,486,530 A | 12/1984 | David et al. |
| 4,683,195 A | 7/1987 | Mullis et al. |
| 4,683,202 A | 7/1987 | Mullis |
| 4,818,540 A | 4/1989 | Chien et al. |
| 4,873,191 A | 10/1989 | Wagner et al. |
| 4,946,778 A | 8/1990 | Ladner et al. |
| 4,950,647 A | 8/1990 | Robins et al. |
| 4,965,188 A | 10/1990 | Mullis |
| 5,143,854 A | 9/1992 | Pirrung et al. |
| 5,290,678 A | 3/1994 | Jackowski |
| 5,322,770 A | 6/1994 | Gelfand |
| 5,350,671 A | 9/1994 | Houghton et al. |
| 5,371,017 A | 12/1994 | Houghton et al. |
| 5,372,928 A | 12/1994 | Miyamura et al. |
| 5,412,087 A | 5/1995 | McGall et al. |
| 5,585,258 A | 12/1996 | Houghton et al. |
| 5,589,466 A | 12/1996 | Felgner et al. |
| 5,593,972 A | 1/1997 | Weiner et al. |
| 5,597,691 A | 1/1997 | Houghton et al. |
| 5,604,105 A | 2/1997 | Jackowski |
| 5,670,152 A | 9/1997 | Weiner et al. |
| 5,670,153 A | 9/1997 | Weiner et al. |
| 5,679,342 A | 10/1997 | Houghton et al. |
| 5,683,864 A | 11/1997 | Houghton et al. |
| 5,698,390 A | 12/1997 | Houghton et al. |
| 5,710,008 A | 1/1998 | Jackowski |
| 5,712,087 A | 1/1998 | Houghton et al. |
| 5,712,088 A | 1/1998 | Houghton et al. |
| 5,712,145 A | 1/1998 | Houghton et al. |
| 5,714,596 A | 2/1998 | Houghton et al. |
| 5,728,520 A | 3/1998 | Weiner et al. |
| 5,739,118 A | 4/1998 | Carrano et al. |
| 5,744,358 A | 4/1998 | Jackowski |
| 5,747,274 A | 5/1998 | Jackowski |
| 5,756,312 A | 5/1998 | Weiner et al. |
| 5,766,845 A | 6/1998 | Weiner et al. |
| 5,767,097 A | 6/1998 | Tam |
| 5,847,101 A | 12/1998 | Okayama et al. |
| 5,856,437 A | 1/1999 | Miyamura et al. |
| 5,863,719 A | 1/1999 | Houghton et al. |
| 5,871,903 A | 2/1999 | Miyamura et al. |
| 5,879,904 A | 3/1999 | Brechot et al. |
| 5,885,799 A | 3/1999 | Houghton et al. |
| 5,932,556 A | 8/1999 | Tam |
| 5,942,234 A | 8/1999 | Ralston et al. |
| 5,959,092 A | 9/1999 | Miyamura et al. |
| 5,968,775 A | 10/1999 | Houghton et al. |
| 5,989,905 A | 11/1999 | Houghton et al. |
| 6,027,729 A | 2/2000 | Houghton et al. |
| 6,056,961 A | 5/2000 | Lavie et al. |
| 6,060,068 A | 5/2000 | Doyle et al. |
| 6,063,380 A | 5/2000 | Chedid et al. |
| 6,063,772 A | 5/2000 | Tam |

(Continued)

FOREIGN PATENT DOCUMENTS
EP    0 388 232    9/1990

(Continued)

OTHER PUBLICATIONS

Forns et al, J Hepatology, 2002, 37:684-695.*
Rice, Hepatitis C:Progress toward New Therapies from Third Annual PHRI Symposium, published 2006, abd downloaded Jan. 23, 2006.*
Orkin et al, Dec. 1995, pp. 21-23, 30-32.*
U.S. Appl. No. 08/008,342, filed Jan. 26, 1993, Weiner et al.
U.S. Appl. No. 08/029,336, filed Mar. 11, 1993, Weiner et al.
U.S. Appl. No. 08/125,012, filed Sep. 21, 1993, Weiner et al.
U.S. Appl. No. 08/221,579, filed Apr. 1, 1994, Carrano et al.
AASLD Abstracts 940, "Hepatitis C Virus NS5A Sequence Configuration does not Predict Response to Induction Interferon Plus Ribavinn," Hepatology, p. 394A (2000).
Abrignani et al., "Perspectives for a vaccine against hepatitis C virus," Journal of Hepatology, 31: (suppl. 1 ):259-263 (1999).
Andre et al., "Increased Immune Response Elicited by DNA Vaccination with a Synthetic gp120 Sequence with Optimized Codon Usage," Journal of Virology, 72(2):1497-1503 (1998).

(Continued)

*Primary Examiner* — Valarie Bertoglio
(74) *Attorney, Agent, or Firm* — Knobbe, Martens, Olson & Bear, LLP

(57) ABSTRACT

The creation of mutant hepatitis C virus (HCV) NS3/4A genes encoding proteins with altered protease activity is disclosed. Embodiments include these NS3/4A genes, HCV peptides encoded by these nucleic acids, nucleic acids encoding these HCV peptides, antibodies directed to these peptides, compositions containing these nucleic acids and peptides, as well as methods of making and using these compositions including, but not limited to, diagnostics and medicaments for the treatment and prevention of HCV infection.

22 Claims, 28 Drawing Sheets

U.S. PATENT DOCUMENTS

Figure 1:
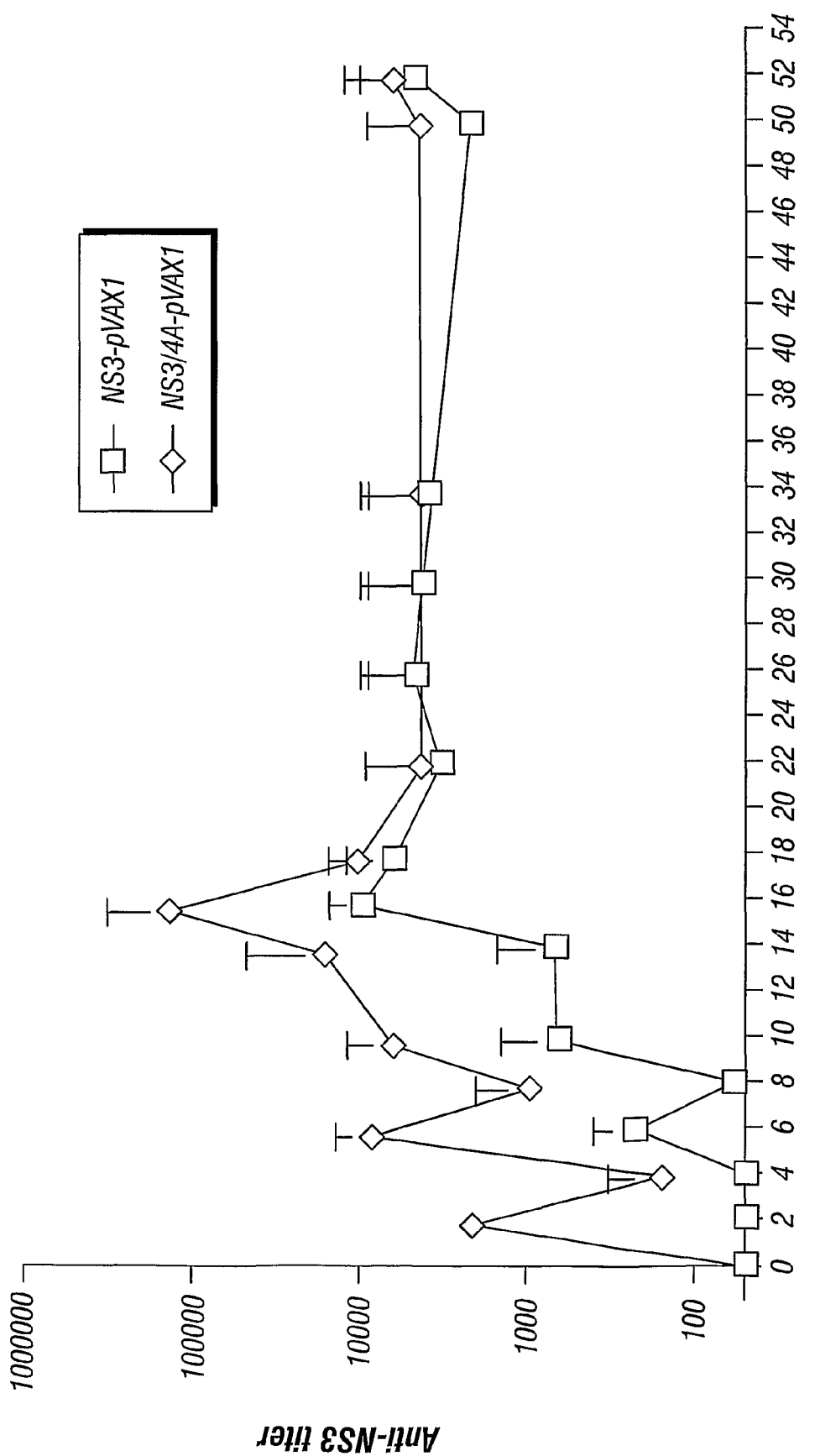

| | | | |
|---|---|---|---|
| 6,071,693 A | 6/2000 | Cha et al. | |
| 6,074,816 A | 6/2000 | Houghton et al. | |
| 6,074,846 A | 6/2000 | Ralston et al. | |
| 6,074,852 A | 6/2000 | Ralston et al. | |
| 6,096,541 A | 8/2000 | Houghton et al. | |
| 6,130,326 A | 10/2000 | Ramasamy et al. | |
| 6,150,087 A | 11/2000 | Chien | |
| 6,150,337 A | 11/2000 | Tam | |
| 6,153,421 A | 11/2000 | Yanagi et al. | |
| 6,171,782 B1 | 1/2001 | Houghton et al. | |
| 6,190,864 B1 | 2/2001 | Cha et al. | |
| 6,194,140 B1 | 2/2001 | Houghton et al. | |
| 6,214,583 B1 | 4/2001 | Cha et al. | |
| 6,235,888 B1 | 5/2001 | Pachuk et al. | |
| 6,274,148 B1 | 8/2001 | Ralston et al. | |
| 6,297,370 B1 | 10/2001 | Cha et al. | |
| 6,303,292 B1 | 10/2001 | Weiner et al. | |
| 6,312,889 B1 | 11/2001 | Houghton et al. | |
| 6,514,731 B1 | 2/2003 | Valenzuela et al. | |
| 6,524,589 B1 * | 2/2003 | Reichert et al. | 424/228.1 |
| 6,541,011 B2 | 4/2003 | Punnonen et al. | |
| 6,555,114 B1 | 4/2003 | Maertens et al. | |
| 6,653,125 B2 | 11/2003 | Donnelly et al. | |
| 6,680,059 B2 | 1/2004 | Sallberg et al. | |
| 6,762,024 B2 | 7/2004 | Maertens et al. | |
| 6,858,590 B2 | 2/2005 | Sallberg et al. | |
| 6,960,569 B2 | 11/2005 | Sallberg | |
| 6,974,864 B2 | 12/2005 | Maertens et al. | |
| 7,022,830 B2 | 4/2006 | Sallberg | |
| 7,056,658 B2 | 6/2006 | Valenzuela et al. | |
| 7,105,303 B2 | 9/2006 | Ralston et al. | |
| 7,122,306 B2 | 10/2006 | Maertens et al. | |
| 7,195,765 B2 | 3/2007 | Maertens et al. | |
| 7,223,743 B2 | 5/2007 | Sallberg | |
| 7,226,912 B2 | 6/2007 | Sallberg | |
| 7,307,066 B2 | 12/2007 | Sallberg | |
| 2002/0165172 A1 | 11/2002 | Sallberg et al. | |
| 2002/0187945 A1 | 12/2002 | Tam | |
| 2003/0007977 A1 | 1/2003 | Wheeler et al. | |
| 2004/0092730 A1 | 5/2004 | Sallberg | |

FOREIGN PATENT DOCUMENTS

| | | |
|---|---|---|
| EP | 0 414 475 | 2/1991 |
| EP | 0 450 931 | 6/1996 |
| EP | 0 543 924 | 6/1997 |
| EP | 0 842 947 | 5/1998 |
| EP | 0 693 687 | 7/1999 |
| EP | 0 556 292 | 12/1999 |
| EP | 1 034 785 | 9/2000 |
| EP | 0 318 216 | 8/2001 |
| EP | 0 398 748 | 1/2002 |
| WO | WO 90/15070 | 12/1990 |
| WO | WO 91/15575 | 10/1991 |
| WO | WO 92/10092 | 6/1992 |
| WO | WO 92/19743 | 11/1992 |
| WO | WO 93/00365 | 1/1993 |
| WO | WO 93/06126 | 4/1993 |
| WO | WO 94/11530 | 5/1994 |
| WO | WO 94/12305 | 6/1994 |
| WO | WO 94/16737 | 8/1994 |
| WO | WO 95/11995 | 5/1995 |
| WO | WO 96/09805 | 4/1996 |
| WO | WO 96/28162 | 9/1996 |
| WO | WO 96/33739 | 10/1996 |
| WO | WO 97/12043 | 4/1997 |
| WO | WO 97/26883 | 7/1997 |
| WO | WO 97/29212 | 8/1997 |
| WO | WO 97/31256 | 8/1997 |
| WO | WO 97/47358 | 12/1997 |
| WO | WO 98/16184 | 4/1998 |
| WO | WO 98/16186 | 4/1998 |
| WO | WO 98/30223 | 7/1998 |
| WO | WO 98/34640 | 8/1998 |
| WO | WO 98/37180 | 8/1998 |
| WO | WO 99/04008 | 1/1999 |
| WO | WO 99/28482 | 6/1999 |
| WO | WO 00/44388 | 8/2000 |
| WO | WO 01/38360 | 5/2001 |
| WO | WO 01/96875 | 12/2001 |
| WO | WO 02/13855 | 2/2002 |
| WO | WO 02/14362 | 2/2002 |
| WO | WO 03/031588 | 4/2003 |
| WO | WO 2004/048402 | 6/2004 |

OTHER PUBLICATIONS

Bartenschlager et al., "Substrate Determinants for Cleavage in cis and in trans by the Hepatitis C Virus NS3 Proteinase," Journal of Virology, pp. 198-205 (1995).
Bitter et al., *Methods in Enzymol.*, 153:516-544 (1987).
BLASTN 2.2.9., May 1, 2004.
Chang et al., Aliment Pharrnacol Ther. Sep. 2002; 16(9): 1623-1632.
Chen et al., "Detection of Hepatitis C Virus RNA in the Cell Fraction of Saliva Before and After Oral Surgery," J. Med. Virol., 43:223-226 (1995).
Chen et al., "Human and Murine Antibody Recognition is Focused on the ATPase/Helicase, but not the Protease Domain of the Hepatitis C Virus Nonstructural 3 Protein," Hepatalogy, 28(1):219-224 (1998).
Chiang at al., "Enhancement of hepatitis C virus core antigen-specific type 1 T helper cell response by ribavirin correlates with the increased level of IL-2," Vaccine Strategies Against Microbial Pathogens, 42.11-42.16, p. A949 Apr. 20, 2000.
Colberre-Garapin, et al., "A new dominant hybrid selective marker for higher eukaryotic cells," *J. Mol. Biol.* 150:1 (1981).
Cote et al., "Generation of human monoclonal antibodies reactive with cellular antigens" *Proc Natl. Acad. Sci.*, 80:2026-2030 (1983).
Cotonat et al., "Pilot Study of Combination Therapy with Ribavirin and Interferon Alfa for the Retreatment of Chronic Hepatitis B e Antibody-Positive Patients", Hepatology, 31(2):502-506 (2000).
Cramp et al., "Hepatitis C Virus-Specific T-Cell Reactivity During Intereron and Ribavirin Treatment in Chronic Hepatitis C," Gastron. Enterol.,118:346-355 (2000).
Database Genbank [Online] Dec. 2, 1994, retrieved from NCBI Database accession No. IO6434, XP002278035.
Database Registry [Online] No. 511600-20-7, XP02278058 abstract & WO 03/031588A, Apr. 17, 2003, Seq ID No. 1, 10 and 11 Claims.
Davis et al., *Human Gene Therapy*, 4(6):733 (1993).
Diepolder et al., "Possible mechanism involving T-lymphocyte response to non-structural protein 3 in viral clearance in acute hepatitis C virus infection," Lancet, 346(8981):1006-1007, 1995.
Encke et al. Intervirology 1999, vol. 42, pp. 117-124.
Encke et al., "Genetic Immunization Generates Cellular and Humoral Immune Responses Against the Nonstructural Proteins of the Hepatitis C Virus in a Murine Model", Journal of Immunology, 161:4917-4923 (1998).
Engvall, E., *Meth. Enzymol*, 70:419 (1980).
Fang et al., "Ribavirin enhancement of hepatitis C virus core antigen-specific type 1 T helper cell response correlates with the Increased IL-12 level," Journal of Hepatology, 33(5):791-798 (2000).
Fodor et al., *Science*, 251:767-773 (1991).
Forns et al. PNAS 2000, vol. 97, pp. 13318-13323.
Forns et al., "Hepatitis C virus lacking the hypervariable region 1 of the second envelope protein is infectious and causes acute resalving or persistent infection in chimpanzees," PNAS, vol. 97, No. 24, pp. 13318-113323, (2000).
Gordon et al., "Immune responses to hepatitis C virus structural and nonstructural proteins induced byplasmid DNA immunizations," Journal of Infectious Diseases, 181(1 ):42-50, 1999.
Grakoui et al., "A second hepatitis C virus-encoded proteinase," Proc. Natl. Acad. Sci USA, 90:10583-10587 (1993).
Hahm et al., "NS3-4A of Hepatitis C Virus is a Chymotrypsin-Like Protease," Journal of Virology, The American Society for Microbiology, 69(4): 2534-2539 (1995).
Heagy et al., J. Clin. Invest. 1991, vol. 87, pp. 1916-1924.
Hosoya et al., *J. INF. Dis.*, 168:641-646 (1993).
Houghten et al., *Proc. Natl. Acad. Sci. USA*, 82:51:32 (1985).
Hsu et al., "Prospects for a Hepatitis C Virus Vaccine", Clin Liver Dis, 3(4):901-915 (1999).
Http://www.msi.com/life/products/cerius2/modules/analogbuilder.html, *C2 Analog Builder*, Jul. 6, 2000.

Huffman et al., "In vitro effect of 1-beta-D-ribofuranosyl-1,2,4-triazole-3-carboxamide (virazole, ICN 1229) on deoxyribonucleic acid and ribonucleic acid viruses," Antimicrob. Agents. Chemother., 3(2):235 (1973).
Hultgren et al. J. Gene. Virol. 1998, vol. 79, pp. 2381-2391.
Hultgren et al., Clin. Diagn. Lab. Immunol. 4:630-632 (1997).
Huse W.D. et al. Science 256:1275-1281 (1989).
Hutchison et al., Proc. Natl. Acad. Sci. USA 253:6551 (1978).
Janknecht, et al., Proc. Natl. Acad. Sci. USA 88:8972-8976 (1991).
Jin et al., "Expression, isolation, and characterization of the hepatitis C virus ATPase/RNA Helicase," Arch. Biochem. Bioplys., 323:47-53 (1995).
Kakumu et al., "Pilot Study of Ribarvirin and Interferon- for Chronic Hepatitis B," Hepatology, 18(2):258-263 (1993).
Kato, "Genome of human hepatitis C virus (HCV): gene organization, sequence diversity, and variation," Microb. Com. Genomics, 5(3):129-151 (2000).
Kozbor et al., Immunol Today 4:72 (1983).
Kumar et al, "Sequence, expression and reconstitution of an HCV genome from a British isolate derived from a single blood donation," Journal of Viral Hepatitis, 7:459-465 (2000).
Kumar et al., "Hepatitis C virus genomic RNA for polyprotein gene," Journal of Hepatology, 7:459-465 (2000).
Kwong et al., "Structure and function of hepatitis C virus NS3 helicase," Curr. Top. Microbiol. Immunol., 242:171-196 (2000).
Kwong et at., "Hepatitis C virus NS3/4A protease," Antiviral Res., 41(1):67-84 (1999).
Lawrence et al., "Advances in the treatment of hepatitis C," Adv. Intern. Med., 45:65-1 05 (2000).
Lazdina et al., "Humoral and CD4 T helper (th) cell responses to the hepatitis C virus non-structural 3 (NS3) protein: NS3 primes TH 1-like responses more effectively as a DNA-Based immunogen than as a recombinant protein," Journal of General Virology, 82:1299-1308 (2001).
Li et al., "Role of the guanosine triphosphatase Rac2 in T helper cell differentiation," Science, 288:2219-2222 (2000).
Lo, Mol. Cell. Biol. 3:1803-1814 (1983).
Logan & Shenk, Proc. Natl. Acad. Sci. USA 81:3655-3659, 1984.
Lohmann et al., "Replication of Subgenomic Hepatitis C Virus RNAs in a Hepatoma Cell Line," Science, 285:110-113, (1999).
Lowy, et al., Cell 22:817 (1980).
Marquardt et al., "Ribavirin inhibits mast cell mediator release," J. Pharmacol. Exp. Therapeutics, 240(1):145-149 (1987).
Marshall et al., "Detection of HCV RNA by the asymmetric gap ligase chain reaction," PCR Methods and Applications, 4(2):80-84 (1994).
Memar O. et al., "Antiviral Agents in Dermatology; Current Status and Future Prospects," Internation Journal of Dermatology, 34(9):597-606 (1995).
Missale et al., "Different clinical behaviors of acute hepatitis C virus infection are associated with different vigor of the anti-viral cell-mediated immune response," J. Clin. Invest., 98(3):706-714 (1996).
Morrison et al. Proc. Natl. Acad. Sci. USA 81:6851-6855 (1984).
Mulligan & Berg, Proc. Natl. Acad. Sci. USA 78:2072 (1981).
NCBI, Genbank, M32084. Hepatitis C Virus . . . [Gi:32987] Aug. 2, 1993.
Neuberger et al., "Recombinant antibodies possessing novel effector functions," Nature, 312:604-608 (1984).
O'Hare, et al., Proc. Natl. Acad. Sci. USA 78:1527 (1981).
Orlandi et al., Proc. Natl. Acad. Sci. 86: 3833-3837 (1989).
Pape et al., "Role of the specific T-cell response for clearance and control of hepatitis C virus," J. Viral. Hepat., Supp. 6, 1:36-40 (1999).
Peavy at al., "Inhibition of murine plaque-forming cell responses in vivo by ribavirin," J. Immunology, 126(3):861-864 (1981).
Powers et al., "Selective Inhibition of functional lymphocyte subpoputations by ribavirin," Antimicrob. Agents. Chemother., 22(1):108-114 (1982).

Proust B. et al., "Two Successive Hepatitis C Virus Infections in an Intravenous Drug User," Journal of Clinical Microbiology, 38(8):3125-3127 (2000).
Ramasamy et al., "Monocyclic L-Nucleosides with Type 1 Cytokine-Inducing Activity," Journal of Medicinal Chemistry, 43(5):1019-1028 (2000).
Rudikoff et al., Immunology 1982, vol. 79, pp. 1979-1983.
Ruther et al., EMBO J., 2:1791 (1983).
Sällberg et al., "Characterization of humoral and CD4+ cellular responses after genetic immunization with retroviral vectors expressing different forms of the hepatitis B virus core and e antigens," Journal of Virology, 71:5295-5303, 1997.
Santerre et al., Gene. 30:147 (1984).
Schulof R. S., "Clinical, Virologic, and Immunologic Effects of Combination Therapy with Ribavirin and Isoprinosine in HIV-Infected Homosexual Men," Journal of Acquired Immune Deficiency Syndromes. 3(5):485-492 (1990).
Sidwell at al., "Broad-spectrum antiviral activity of Virazole: 1-beta-D-ribofuranosyl-1,2,4-triazole-3-carboxamide," Science, 177(50):705-706 (1972).
Smith at al., "Molecular Engineering of the Autographa californica Nuclear Polyhedrosis Virus Genome: Deletion Mutations Within the Polyhedrin Gene," Journal of Virology, 46:584 (1983).
Spector et al., "The Antviral Effect of Zidovudine and Ribavirin in Clinical Trials and the Use of p24 Antigen Levels as a Virologic Marker," Journal of Infectious Diseases, 159(5):822-828 (1989).
Steigerwald-Mullen et al., J. Virol. 2000, vol. 74, No. 15, pp. 6748-6759.
Szybalska and Szybalska, "Genetics of Human Cell Lines, IV. DNA-Mediated Heritable Transformationof a Biochemical Trait," Proc Natl Acad Sci USA, 48:2026 (1962).
Takeda et al., "Construction of chimaeric processed immunoglobulin genes containing mouse variable and human constant region sequences," Nature, 314:452-454 (1985).
Tam et al., "Ribavirin Polarizes Human T Cell Responses Towards a Type 1 Cytokine Profile," Journal of Hepatology, 30(3):376-382 (1999) (Abstract).
Tam et al., "The Immunomodulatory effects of ribavirin: Recent findings," International Antiviral News, 7/6:99-100 (1999).
Tan et al., "How hepatitis C virus counteracts the interferon response: the jury is still out on NS5A," Virology, 284(1):1-12 (2001).
Thompson et al., Cell 56:313-321 (1989).
Townsend et al., J. Virol. 71:3365 (1997).
Vaitukaitis et al., "A method for producing specific antisera with small doses of immunogen," J. Clin. Endocrinology Metab., 33(6):988-991 (1971).
Van der Putten et al., Proc. Natl. Acad. Sci., USA 82:6148-6152 (1985).
Walsh et al., "Update on chronic viral hepatitis", Postgrad Medical Journal, 77(910):498-505 (2001).
Wang et al., "Synthesis and Cytokine Modulation Properties of Pyrrolo[2,3,-d]-4-pyrimidone Nucleosides," J. Med. Chem., 43(13):2566.2574 (2000).
Wigler et al., Cell 11:223 (1977).
Wigler et al., Proc. Natl. Acad. Sci. USA 77:3567 (1980).
Winter G. and Milstein C; Nature 349:293-299 (1991).
Zhang et al., "Characterization of a monoclonal antibody and its singl-chain antibody fragment recognizing the nucleoside triphosphatase/helicase domain of the hepatitis C virus nonstructural 3 protein," Clin. Diagn. Lab. Immunol., 7(1 ):58-63 (2000).
Zhang et al., "Interferon.alpha. Treatment Induces Delayed CD4 Proliferative Responses to the Hepatitis C Virus Nonstructural Protein 3 Regardless of the Outcome of Therapy," The Journal of Infectious Diseases, 175:1294-1301 (1997).
Zhang et al., "Molecular basis for antibody cross-reactivity between the hepatitis C virs core protein and the hos-derived GOR protein," Clin. Exp. Immunol., 96(3):403-409 (1994).

* cited by examiner

0 = Complete destruction of the protease activity

1

2

3 = NS3 amount equal to NS3-4A amount

4

5

6 = Total cleavage

Amino Acids 2-187 from SEQ ID No. 2

APITAYAQQTRGLLGCIITSLTGRDKNQVEGEVQIVS

TAAQTFLATCINGVCWTVYHGAGTRTIASPKGPVIQM

YTNVDQDLVGWPAPQGARSLTPCTCGSSDLYLVTRHA

DVIPVRRRGDGRGSLLSPRPISYLKGSSGGPLLCPAG

HAVGIFRAAVCTRGVAKAVDFIPVESLETTMRS

FIG. 17

HEPATITIS C VIRUS NON-STRUCTURAL NS3/4A FUSION GENE

CROSS REFERENCE TO RELATED APPLICATION

This application claims benefit and priority to and is a U.S. National Phase of PCT Application Number PCT/IB2006/002607, filed on May 24, 2006, designating the United States of America and published in the English language, which claims priority to U.S. Provisional Application Ser. No. 60/685,014, filed May 25, 2005. The disclosures of the above-referenced applications are hereby expressly incorporated by reference in their entireties.

FIELD OF THE INVENTION

Aspects of the present invention relate to the creation of a novel hepatitis C virus (HCV) NS3/4A gene, in which the serine protease domain of NS3 has been mutated. Embodiments include the mutated NS3/4A genes, codon-optimized versions of the mutated genes, HCV peptides encoded by said gene, nucleic acids encoding said HCV peptides, antibodies directed to said peptides, compositions containing said nucleic acids and peptides, as well as methods of making and using the aforementioned compositions including, but not limited to, diagnostics and medicaments for the treatment and prevention of HCV infection.

BACKGROUND OF THE INVENTION

Viruses are intracellular parasites that require the biochemical machinery of a host cell for replication and propagation. All virus particles contain some genetic information that encodes viral structural proteins and enzymes. The genetic material may be DNA or RNA, in double- or single stranded form. (*Virology*, Fields ed., third edition, Lippencott-Raven publishers, pp 72-83 (1996)). The viral nucleic acid is surrounded by a coat of proteins called the capsid. (Id.) In some viruses the capsid is surrounded by an additional layer comprised of a lipid membrane, referred to as the envelope. (Id. at 83-95).

The typical viral life cycle begins with infection of a host cell through attachment of the virus particle to a cell surface receptor and internalization of the viral capsid. (Id. at 103). Accordingly, a virus' host range is limited to cells that express an appropriate cell surface receptor. Once internalized, the virus particle is disassembled and its nucleic acid is transcribed, translated or replicated. (Id.) At this point, the virus may undergo lytic replication, where new virus particles are formed and released from the infected cell. (Id. at 105-11). The Influenza virus is a typical example of a virus that undergoes lytic replication immediately upon infection of a host cell. (Id. at 1369-85).

Alternatively, a virus may enter a latent phase, referred to as lysogeny, where the genome is replicated but few if any viral proteins are actually expressed and viral particles are not formed. (Id. at 219-29). Herpesviruses such as the Epstein-Barr Virus are typical examples of viruses that establish latent infection in the host cells. (Id. at 229-34). Eventually, in order for the virus to spread, it must exit lysogeny and enter the lytic phase. The viral particles that are released during the lytic phase infect other cells of the same individual or can be transmitted to another individual where a new infection is established.

Since the viral life cycle comprises both an intracellular and extracellular phase, both the humoral and cell-mediated immune defense systems are important for combating viral infections. (Id. at 467-73). Antibodies directed against viral proteins may block the virus particle's interaction with its cellular receptor or otherwise interfere with the internalization or release processes. (Id. at 471). An antibody capable of interfering with the viral life cycle is referred to as a neutralizing antibody.

During intracellular replication, viral proteins, which are foreign to the host cell, are produced and some of these proteins are digested by cellular proteases after coupling to a Major Histocompatibility Complex (MHC) molecule presented on the surface of the infected cell. (Id. at 350-58). Thus, the infected cell is recognized by T-lymphocytes, macrophages or NK-cells and killed before the virus replicates and spreads to adjacent cells. (Id. at 468-70). In addition, the presence of viral nucleic acids, most notably as double-stranded RNA, triggers the infected cell to shut down its translation machinery and to produce antiviral signaling molecules known as interferons. (Id. at 376-79).

Viruses have evolved various means of evading the immune defense system of the host, however. By establishing latency (i.e., lysogeny), for example, the virus does not enter the lytic phase and avoids the humoral immune defense system. (Id. at 224). During the latent phase, few viral proteins are produced and infected cells have only a minimal ability to present evidence to surrounding lymphocytes and macrophages of their infected state. (Id. at 225-26). Additionally, some viral proteins, most notably those produced during latency, evolve polypeptide sequences that cannot be efficiently presented to the cell mediated immune defense system. (Levitskaya et al., *Nature* 375:685-88 (1995)). Finally, some viruses may actively interfere with the immune response of the infected host, for instance by preventing surface expression of MHC molecules (Fruh et al., *J. Mol. Med.* 75:18-27 (1997)), or by disrupting interferon signaling (Fortunato et al., *Trends Microbiol.* 8:111-19 (2000)).

Particularly evasive are the hepatitis viruses, which are not classified as a family but are grouped based on their ability to infect cells of the liver. Hepatitis C Virus (HCV) belongs to the Flaviviridae family of single-stranded RNA viruses. (*Virology*, supra, pp 945-51). The HCV genome is approximately 9.6 kb in length, and encodes at least ten polypeptides. (Kato, *Microb. Comp. Genomics*, 5:129-151 (2000)). The genomic RNA is translated into one single polyprotein that is subsequently cleaved by viral and cellular proteases to yield the functional polypeptides. (Id.) The polyprotein is cleaved to three structural proteins (core protein, E1 and E2), to p7 of unknown function, and to six non-structural (NS) proteins (NS2, NS3, NS4A/B, NS5A/B). (Id.) NS3 encodes a serine protease that is responsible for some of the proteolytic events required for virus maturation (Kwong et al., *Antiviral Res.*, 41:67-84 (1999)) and NS4A acts as a co-factor for the NS3 protease. (Id.) NS3 further displays NTPase activity, and possesses RNA helicase activity in vitro. (Kwong et al., *Curr. Top. Microbiol. Immunol.*, 242:171-96 (2000)).

HCV infection typically progresses from an acute to a chronic phase. (*Virology*, supra, pp 1041-47). Acute infection is characterized by high viral replication and high viral load in liver tissue and peripheral blood. (Id. at 1041-42.) The acute infection is cleared by the patient's immune defense system in roughly 15% of the infected individuals; in the other 85% the virus establishes a chronic, persistent infection. (Lawrence, *Adv. Intern. Med.*, 45:65-105 (2000)). During the chronic phase replication takes place in the liver, and some virus can be detected in peripheral blood. (*Virology*, supra, pp 1042).

Essential to the establishment of a persistent infection is the evolution of strategies for evading the host's immune defense system. HCV, as a single stranded RNA virus, displays a high mutation rate in the replication and transcription of its genome. (Id. at 1046). Thus, it has been noted that the antibodies produced during the lytic phase seldom neutralize virus strains produced during chronic infection. (Id.) Although it appears HCV is not interfering with antigen processing and presentation on MHC-I molecules, the viral NS5A protein may be involved in repression of interferon signaling through inhibition of the PKR protein kinase. (Tan et al., *Virology*, 284:1-12 (2001)).

The infected host mounts both a humoral and a cellular immune response against the HCV virus but in most cases the response fails to prevent establishment of the chronic disease. Following the acute phase, the infected patient produces antiviral antibodies including neutralizing antibodies to the envelope proteins E1 and E2. (Id. at 1045). This antibody response is sustained during chronic infection. (Id.) In chronically infected patients, the liver is also infiltrated by both CD8+ and CD4+ lymphocytes. (Id. at 1044-45). Additionally, infected patients produce interferons as an early response to the viral infection. (Id. at 1045). It is likely that the vigor of the initial immune response against the infection determines whether the virus will be cleared or whether the infection will progress to a chronic phase. (Pape et al., *J. Viral. Hepat.*, 6 Supp. 1:36-40 (1999)). Despite the efforts of others, the need for efficient immunogens and medicaments for the prevention and treatment of HCV infection is manifest.

SUMMARY OF THE INVENTION

A new HCV isolate was discovered. A novel NS3/4A fragment of the HCV genome was cloned and sequenced from a patient infected with HCV (SEQ. ID. NO.: 1). This sequence was found to be only 93% homologous to the most closely related HCV sequence. Embodiments comprise, consist, or consist essentially of this peptide (SEQ. ID. NO.: 2) or fragments thereof containing any number of consecutive amino acids between at least 3-50 amino acids of SEQ. ID. NO.: 2 (e.g., 3, 4, 6, 8, 10, 12, 15, 20, 25, 30, 35, 40, 45, or 50 consecutive amino acids), nucleic acids encoding these molecules, vectors having said nucleic acids, and cells having said vectors, nucleic acids, or peptides. The NS3/4A nucleic acid, fragments thereof and corresponding peptides were found to be immunogenic. Accordingly, preferred embodiments include vaccine compositions and immunogen preparations comprising, consisting of, or consisting essentially of the HCV peptide of SEQ. ID. NO.: 2 or fragments thereof (e.g., SEQ. ID. NOs.: 14 and 15) containing any number of consecutive amino acids between at least 3-50 amino acids of SEQ. ID. NO.: 2 (e.g., 3, 4, 6, 8, 10, 12, 15, 20, 25, 30, 35, 40, 45, or 50 consecutive amino acids) or a nucleic acid encoding said peptide or fragments.

Mutants of the NS3/4A peptide were also created and were found to be immunogenic. Some mutants are truncated versions of the NS3/4A peptide (e.g., SEQ. ID. NOs.: 12 and 13) and others lack a proteolytic cleavage site (e.g., SEQ. ID. NOs.: 3-11). Other mutants have single amino acid substitutions throughout the protease domain of NS3 (e.g., SEQ ID NOs." 40-220). These peptides (e.g., SEQ. ID. NOs.: 3-13 and SEQ ID NOs.: 40-220) and fragments thereof containing any number of consecutive amino acids between at least 3-50 amino acids (e.g., 3, 4, 6, 8, 10, 12, 15, 20, 25, 30, 35, 40, 45, or 50 consecutive amino acids) of any one of SEQ. ID. NOs.: 3-13 (e.g., SEQ. ID. NOs.: 15-26), or of SEQ ID NOs: 40-220 wherein the fragment includes the mutation, nucleic acids encoding these molecules, vectors having said nucleic acids, and cells having said vectors, nucleic acids, or peptides are embodiments of the invention. A particularly preferred embodiment is a vaccine composition or immunogen preparation comprising, consisting of, or consisting essentially of at least one HCV peptide of SEQ. ID. NOs.: 3-11 or a fragment thereof containing any number of consecutive amino acids between at least 3-50 amino acids (e.g., 3, 4, 6, 8, 10, 12, 15, 20, 25, 30, 35, 40, 45, or 50 consecutive amino acids) of any one of SEQ. ID. NOs.: 3-11 (e.g., SEQ. ID. NOs.: 16-26) or a nucleic acid encoding said peptides or fragments.

Additional embodiments include a NS3/4A encoding nucleic acid or corresponding peptide, which comprise a sequence that was optimized for codons most frequently used in humans. The nucleic acid sequence of the codon-optimized NS3/4A nucleic acid sequence (coNS3/4A) is provided in SEQ. ID. NO.: 35, whereas the peptide encoded by said nucleic acid sequence is provided in SEQ. ID. NO.: 36. This nucleic acid and corresponding NS3/4A peptide do not correspond to any known HCV sequence or genome. The codon-optimized NS3/4A encoding nucleic acid was found to be only 79% homologous, within the region of nucleotide positions 3417-5475, to HCV-1 and contained a total of 433 different nucleotides. The NS3/4A peptide encoded by the codon-optimized nucleic acid sequence was only 98% homologous to HCV-1 and contained a total of 15 different amino acids. The codon optimized nucleic acid was found to generate a higher expression level of NS3 and was found to be more immunogenic, with respect to both humoral and cellular responses, as compared to the native NS3/4A gene.

Transient transfections of human HepG2 cells showed that the coNS3/4A gene gave 11-fold higher levels of NS3 as compared to the wtNS3/4A gene when using the CMV promoter. It was also shown that the presence of NS4A enhances expression by Semliki Forest virus (SFV). The wild-type NS3/4A containing SFV constructs were made by isolating the wtNS3/4A gene by polymerase chain reaction as a SpeI-BStB1 fragment, which was inserted into the SpeI-BStB1 site of pSFV10Enh containing a 34 amino acid long translational enhancer sequence of capsid followed by the FMDV2a cleavage peptide. Packaging of recombinant RNA into rSFV particles was done using a two-helper RNA system. Both codon optimization and the mRNA amplification mediated by SFV replicase resulted in an improved immunogenicity as evidenced by higher levels of NS3-specific antibodies. This improved immunogenicity also resulted in a more rapid priming of cytotoxic T lymphocytes (CTLs). Since HCV is a non-cytolytic virus, the functionality of the primed CTL responses was evaluated by an in vivo challenge with NS3/4A-expressing syngeneic tumor cells. The priming of a tumor protective immunity required an endogenous production of the immunogen and CD8+ CTLs, but was independent of B and CD4+ T cells. This model confirmed the more rapid in vivo activation of an NS3/4A-specific tumor inhibiting immunity by codon optimization and mRNA amplification. Finally, therapeutic vaccination with the coNS3/4A gene using gene gun six to 12 days after injection of tumors, significantly reduced the tumor growth in vivo. Codon optimization and mRNA amplification effectively enhances the overall immunogenicity of NS3/4A. Thus, either, or both, of these approaches are preferred in an NS3/4A-based HCV genetic vaccine.

Other mutants of the NS3/NS4A peptide were created. Some mutants are truncated versions of the NS3/4A peptide (e.g., SEQ. ID. NOs.: 12 and 13) and others lack a proteolytic cleavage site (e.g., SEQ. ID. NOs.: 3-11). These peptides (e.g., SEQ. ID. NOs.: 3-13) and fragments thereof containing any number of consecutive amino acids between at least 3-50 amino acids (e.g., 3, 4, 6, 8, 10, 12, 15, 20, 25, 30, 35, 40, 45, or 50 consecutive amino acids) of any one of SEQ. ID. NOs.: 3-13 (e.g., SEQ. ID. NOs.: 15-26), nucleic acids encoding these molecules, vectors having said nucleic acids, and cells having said vectors, nucleic acids, or peptides are embodiments of the invention. A particularly preferred embodiment is a vaccine composition or immunogen preparation comprising, consisting of, or consisting essentially of at least one HCV peptide of SEQ. ID. NOs.: 3-11 or a fragment thereof containing any number of consecutive amino acids between at least 3-50 amino acids (e.g., 3, 4, 6, 8, 10, 12, 15, 20, 25, 30, 35, 40, 45, or 50 consecutive amino acids) of any one of SEQ. ID. NOs.: 3-11 (e.g., SEQ. ID. NOs.: 16-26) or a nucleic acid encoding said peptides or fragments.

Yet other mutants of the NS3/4A peptide were also created, and were found to have altered protease activity (e.g., SEQ ID NOs: 40-220). For example, some mutants have an alanine substitution or a glycine substitution in the NS3 protease domain that abolishes, reduces, enhances, or greatly enhances the protease activity. Another preferred embodiment is a vaccine composition or immunogen preparation comprising, consisting of, or consisting essentially of at least one HCV peptide of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220, or a fragment thereof containing any number of consecutive amino acids between at least 3-50 amino acids (e.g., 3, 4, 6, 8, 10, 12, 15, 20, 25, 30, 35, 40, 45, or 50 consecutive amino acids) wherein said fragment includes the mutation present in the NS3 protease domain, or a nucleic acid encoding said peptides or fragments. These peptides (e.g., SEQ. ID. NOs.: 40-220) and fragments thereof containing any number of consecutive amino acids between at least 3-50 amino acids (e.g., 3, 4, 6, 8, 10, 12, 15, 20, 25, 30, 35, 40, 45, or 50 consecutive amino acids) of any one of SEQ. ID. NOs.: 40-220, nucleic acids encoding these molecules, vectors having said nucleic acids, and cells having said vectors, nucleic acids, or peptides are embodiments of the invention.

Aspects of the present invention include compositions that comprise, consist, or consist essentially of the nucleic acid sequence provided by the sequence of SEQ. ID. NO.: 35 and/or the peptide sequence provided by the sequence of SEQ. ID. NO.: 36. Preferred embodiments, for example, include compositions that comprise, consist or consist essentially of any number of consecutive nucleotides between at least 12-2112 nucleotides of SEQ. ID. NO.: 35 or a complement thereof (e.g., 12-15, 15-20, 20-30, 30-50, 50-100, 100-200, 200-500, 500-1000, 1000-1500, 1500-2079, or 1500-2112 consecutive nucleotides). Preferred embodiments also include compositions that comprise, consist or consist essentially of any number of consecutive nucleotides between at least 12-2112 nucleotides of SEQ. ID. NO.: 35 or a complement thereof (e.g., at least 3, 4, 6, 8, 10, 12, 15, 20, 30, 40, 50, 60, 70, 80, 90, or 100 consecutive nucleotides acids of SEQ. ID. NO.: 35). Additional embodiments include nucleic acids that comprise, consist, or consist essentially of a sequence that encodes SEQ. ID. NO.: 36 or a fragment thereof, that is, any number of consecutive amino acids between at least 3-50 amino acids of SEQ. ID. NO.: 36 (e.g., 3, 4, 6, 8, 10, 12, 15, 20, 25, 30, 35, 40, 45, or 50 consecutive amino acids). Still more embodiments include peptides that comprises, consist, or consist essentially of the sequence of SEQ. ID. NO.: 36 or a fragment thereof, that is, any number of consecutive amino acids between at least 3-50 amino acids of SEQ. ID. NO.: 36 (e.g., 3, 4, 6, 8, 10, 12, 15, 20, 25, 30, 35, 40, 45, or 50 consecutive amino acids).

Other preferred embodiments include compositions that comprise, consist, or consist essentially of any number of consecutive nucleotides between at least 12-2112 nucleotides that encode the polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220, wherein the nucleic acid includes the coding sequence for the mutation in the NS3 protease domain of the above NS3/NS4A polypeptides, or a complement thereof, (e.g., 12-15, 15-20, 20-30, 30-50, 50-100, 100-200, 200-500, 500-1000, 1000-1500, 1500-2079, or 1500-2112 consecutive nucleotides).

Methods of making and using the compositions described herein are also provided. In addition to methods of making the embodied nucleic acids and peptides, other embodiments include methods of making immunogens and/or vaccine compositions that can be used to treat or prevent HCV infection. Some methods are practiced, for example, by mixing an adjuvant with a peptide or nucleic acid antigen (e.g., an HCV peptide or HCV nucleic acid), as described above, so as to formulate a single composition (e.g., a vaccine composition). Preferred methods involve the mixing of ribavirin with an HCV gene or antigen disclosed herein.

Preferred methods of using the compositions described herein involve providing an animal in need of an immune response to HCV with a sufficient amount of one or more of the nucleic acid or peptide embodiments described herein. By one approach, for example, an animal in need of an immune response to HCV (e.g., an animal at risk or already infected with HCV, such as a human) is identified and said animal is provided an amount of NS3/4A (SEQ. ID. NO.: 2 or SEQ. ID. NO.: 36), a mutant NS3/4A (SEQ. ID. NOs.: 3-13), a fragment thereof (e.g., SEQ. ID. NOs.: 14-26) or a nucleic acid encoding said molecules that is effective to enhance or facilitate an immune response to the hepatitis viral antigen. Additional methods are practiced by identifying an animal in need of a potent immune response to HCV and providing said animal a composition comprising a peptide comprising an antigen or epitope present on SEQ. ID. NOs.: 2-27 or SEQ. ID. NO.: 36 or a nucleic acid encoding said peptides. Particularly preferred methods involve the identification of an animal in need of an immune response to HCV and providing said animal a composition comprising an amount of HCV antigen (e.g., NS3/4A (SEQ. ID. NO.: 2 or SEQ. ID. NO.: 36)), mutant NS3/4A (SEQ. ID. NOs.: 3-13), a fragment thereof containing any number of consecutive amino acids between at least 3-50 amino acids (e.g., 3, 4, 6, 8, 10, 12, 15, 20, 25, 30, 35, 40, 45, or 50 consecutive amino acids) of SEQ. ID. NO.: 2 or SEQ. ID. NO.: 36 (e.g., SEQ. ID. NOs.: 14-26) or a nucleic acid encoding one or more of these molecules that is sufficient to enhance or facilitate an immune response to said antigen. In some embodiments, the composition described above also contains an amount of ribavirin that provides an adjuvant effect.

Other approaches concern identifying an animal in need of an immune response to HCV and providing an amount of NS3/4A polypeptides with altered protease activity, or mutations in the NS3 protease domain (e.g., SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220, a fragment thereof, or a nucleic acid encoding said molecules that is effective to enhance or facilitate an immune response to the hepatitis viral antigen. Additional methods are practiced by identifying an animal in need of a potent immune response to HCV and providing said animal a composition comprising a peptide comprising an antigen or epitope present on SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220 or a nucleic acid encoding said peptides. Particularly preferred methods involve the identification of an animal in need of an immune response to HCV and providing said animal a composition comprising an amount of HCV antigen (e.g. SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220), a fragment thereof containing any number of consecutive amino acids between at least 3-50 amino acids, wherein the fragment includes the mutation in the NS3 protease domain, (e.g., 3, 4, 6, 8, 10, 12, 15, 20, 25, 30, 35, 40, 45, or 50 consecutive amino acids), or a nucleic acid encoding one or more of these molecules that is sufficient to enhance or facilitate an immune response to said antigen. In some embodiments, the composition described above also contains an amount of ribavirin that provides an adjuvant effect.

In still more embodiments, for example, a gene gun is used to administer an HCV nucleic acid described herein (e.g., SEQ. ID. NO.: 35 or fragment thereof, as described above) to a mammalian subject in need of an immune response to HCV. In some embodiments, an amount of ribavirin is mixed with the DNA immunogen prior to delivery with the gene gun. In other embodiments, the DNA immunogen is provided by gene gun shortly before or after administration of ribavirin at or near the same site of DNA inoculation. For example, in some embodiments, a gene gun or a transdermal delivery system is used to administer HCV nucleic acids including nucleic acids encoding the NS3/NS4A polypeptides with altered protease activity. Accordingly, a gene gun or a transdermal delivery system is used to deliver nucleotides encoding the NS3/NS4A polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, and SEQ ID NO: 220, or fragments thereof that contain the mutation in the NS3 protease domain, either with or without ribavirin.

In still other embodiments, transdermal delivery systems are used to deliver an HCV polypeptide described herein to a mammalian subject in need of an immune response to HCV. In some embodiments, an amount of ribavirin is mixed and delivered transdermally with the HCV polypeptide. In other embodiments, an amount of ribavirin is transdermally delivered to a mammal shortly before or shortly after transdermal delivery of the HCV polypeptide, at or near the same site as the polypeptide. For example, embodiments include transdermal delivery of NS3/NS4A polypeptides having altered protease activity. Thus, in some embodiments, the NS3/NS4A polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, and SEQ ID NO: 220 are delivered transdermally to a mammalian subject in need of an immune response to HCV, either with or without ribavirin.

BRIEF DESCRIPTION OF THE DRAWINGS

FIG. 1 is a graph showing the antibody titer in H-$2^d$ mice against NS3 as a function of time after the first intra muscular immunization. Diamonds denote antibody titer in mice immunized with NS3/4A-pVAX and squares denote antibody titer in mice immunized with NS3-pVAX.

FIG. 2 shows the in vivo protection conferred by one gene gun immunization of NS3/4A-pVAX1 (4 μg) or MSLF1-pVAX1 (4 μg). Mice were immunized with the respective plasmid and 14 days later the mice were challenged with an NS3/4A expressing SP2/0 cell line (approximately $10^6$ cells/mouse). Tumor size was then measured through the skin daily following day 6 post-challenge and the data plotted.

FIG. 3 shows the in vivo protection conferred by two gene gun immunizations of NS3/4A-pVAX1 (4 μg) or MSLF1-pVAX1 (4 μg). Mice were immunized with the respective plasmid at weeks zero and week four and, 14 days after the last immunization, the mice were challenged with an NS3/4A expressing SP2/0 cell line (approximately $10^6$ cells/mouse). Tumor size was then measured through the skin daily following day 6 post-challenge and the data plotted.

FIG. 4 shows the in vivo protection conferred by three gene gun immunizations of NS3/4A-pVAX1 (4 μg) or MSLF1-pVAX1 (4 μg). Mice were immunized with the respective plasmid at weeks zero, week four, and week eight and, 14 days after the last immunization, the mice were challenged with an NS3/4A expressing SP2/0 cell line (approximately $10^6$ cells/mouse). Tumor size was then measured through the skin daily following day 6 post-challenge and the data plotted.

FIG. 5A is a graph showing the percentage of specific CTL-mediated lysis of SP2/0 target cells as a function of the effector to target ratio. Phosphate Buffered Saline (PBS) was used as a control immunogen.

FIG. 5B is a graph showing the percentage specific CTL-mediated lysis of SP2/0 target cells as a function of the effector to target ratio. Plasmid NS3/4A-pVAX was used as the immunogen.

FIG. 6A is a graph showing the response of naive splenic T cells that were stimulated with peptide coated RMA-S cells. The naive splenic T cells were obtained from C57/BL6 mice.

FIG. 6B is a graph showing the response of splenic T cells that were restimulated with peptide coated RMA-S cells. The splenic T cells were obtained from C57/BL6 mice that were provided a single 4 μg dose of MSLF1-pVAX1.

FIG. 6C is a graph showing the response of splenic T cells that were restimulated with peptide coated RMA-S cells. The splenic T cells were obtained from C57/BL6 mice that were provided a single 4 μg dose of NS3/4A-pVAX1.

FIG. 6D is a graph showing the response of naive splenic T cells that were stimulated with peptide coated RMA-S cells. The naive splenic T cells were obtained from C57/BL6 mice.

FIG. 6E is a graph showing the response of splenic T cells that were restimulated with peptide coated RMA-S cells. The splenic T cells were obtained from C57/BL6 mice that were provided two 4 μg doses of MSLF1-pVAX1.

FIG. 6F is a graph showing the response of splenic T cells that were restimulated with peptide coated RMA-S cells. The splenic T cells were obtained from C57/BL6 mice that were provided two 4 μg doses of NS3/4A-pVAX1.

FIG. 6G is a graph showing the response of naive splenic T cells that were stimulated with NS3/4A expressing EL-4 cells. The naive splenic T cells were obtained from C57/BL6 mice.

FIG. 6H is a graph showing the response of splenic T cells that were restimulated with NS3/4A expressing EL-4 cells. The splenic T cells were obtained from C57/BL6 mice that were provided a single 4 μg dose of MSLF1-pVAX1.

FIG. 6I is a graph showing the response of splenic T cells that were restimulated with NS3/4A expressing EL-4 cells. The splenic T cells were obtained from C57/BL6 mice that were provided a single 4 μg dose of NS3/4A-pVAX1.

FIG. 6J is a graph showing the response of naive splenic T cells that were stimulated with NS3/4A expressing EL-4 cells. The naive splenic T cells were obtained from C57/BL6 mice.

FIG. 6K is a graph showing the response of splenic T cells that were restimulated with NS3/4A expressing EL-4 cells. The splenic T cells were obtained from C57/BL6 mice that were provided two 4 μg doses of MSLF1-pVAX1.

FIG. 6L is a graph showing the response of splenic T cells that were restimulated with NS3/4A expressing EL-4 cells. The splenic T cells were obtained from C57/BL6 mice that were provided two 4 μg doses of NS3/4A-pVAX1.

FIG. 7 is a graph showing the humoral response to 10 and 100 μg recombinant Hepatitis C virus (HCV) non structural 3 protein (NS3), as determined by mean end point titres, when a single dose of 1 mg of ribavirin was co-administered.

FIG. 8 is a graph showing the humoral response to 20 μg recombinant Hepatitis C virus (HCV) non structural 3 protein (NS3), as determined by mean end point titres, when a single dose of 0.1, 1.0, or 10 mg of ribavirin was co-administered.

FIG. 9 is a graph showing the effects of a single dose of 1 mg ribavirin on NS3-specific lymph node proliferative responses, as determined by in vitro recall responses.

FIG. 10 shows the mean NS3-specific antibody responses primed by gene gun immunisations with 4 μg wtNS3/4A-pVAX1 and coNS3/4A-pVAX1, or s.c. injection of $10^7$ wtNS3/4A-SFV particles in groups of ten H-$2^d$ mice (a). All mice were immunized at weeks zero and four. Values are given as mean end-point antibody titres (±SD.). Also shown (b) are the IgG subclass patterns from groups of five mice immunized twice with wtNS3/4A-pVAX1 given i.m., coNS3/4A-pVAX1 given i.m. or by gene gun (gg), and wtNS3/4A-SFV given s.c. Values are given as mean end-point antibody titres (±SD.). A "**" sign indicates a statistical difference of $p<0.01$, a "*" sign indicates a difference of $p<0.05$, and NS (not significant) indicates no statistical difference (Mann-Whitney). Also given is the titer ratio obtained by dividing the mean endpoint titre of IgG2a antibodies to NS3 by the mean endpoint titre IgG1 antibodies to NS3. A high ratio (>3) indicates a Th1-like response and a low ratio (<0.3) indicates a Th2-like response, whereas values within a three-fold difference from 1 (0.3 to 3) indicates a mixed Th1/Th2 response.

FIG. 11 shows a flow cytometric quantification of the precursor frequency of NS3/4A-specific CD8+ T cells using peptide-loaded H-$2D^b$:Ig fusion protein. In a) the mean % NS3-specific CD8+ T cells from groups of five mice immunized twice with wtNS3-pVAX1, wtNS3/4A-pVAX1, or coNS3/4A-pVAX1 using gene gun is shown. A "*" sign indicates a difference of $p<0.05$, and NS (not significant) indicates no statistical difference (Mann-Whitney). Also shown are the raw data from representative individual mice from the groups listed above (e, f, and h), as well as from individual mice immunized once with coNS3/4A-pVAX1 (b) or wtNS3/

4A-SFV (c). In (d) and (g), non-immunized control mice from the different experiments have been given. In (i) and (j) the splenocytes were restimulated for five days with the NS3-peptides prior to analysis. A total of 150,000-200,000 data points were collected and the percentage of CD8+ cells stained for H-2D$^b$:Ig are indicated in the parentheses in each dot-plot.

Figure 12A:
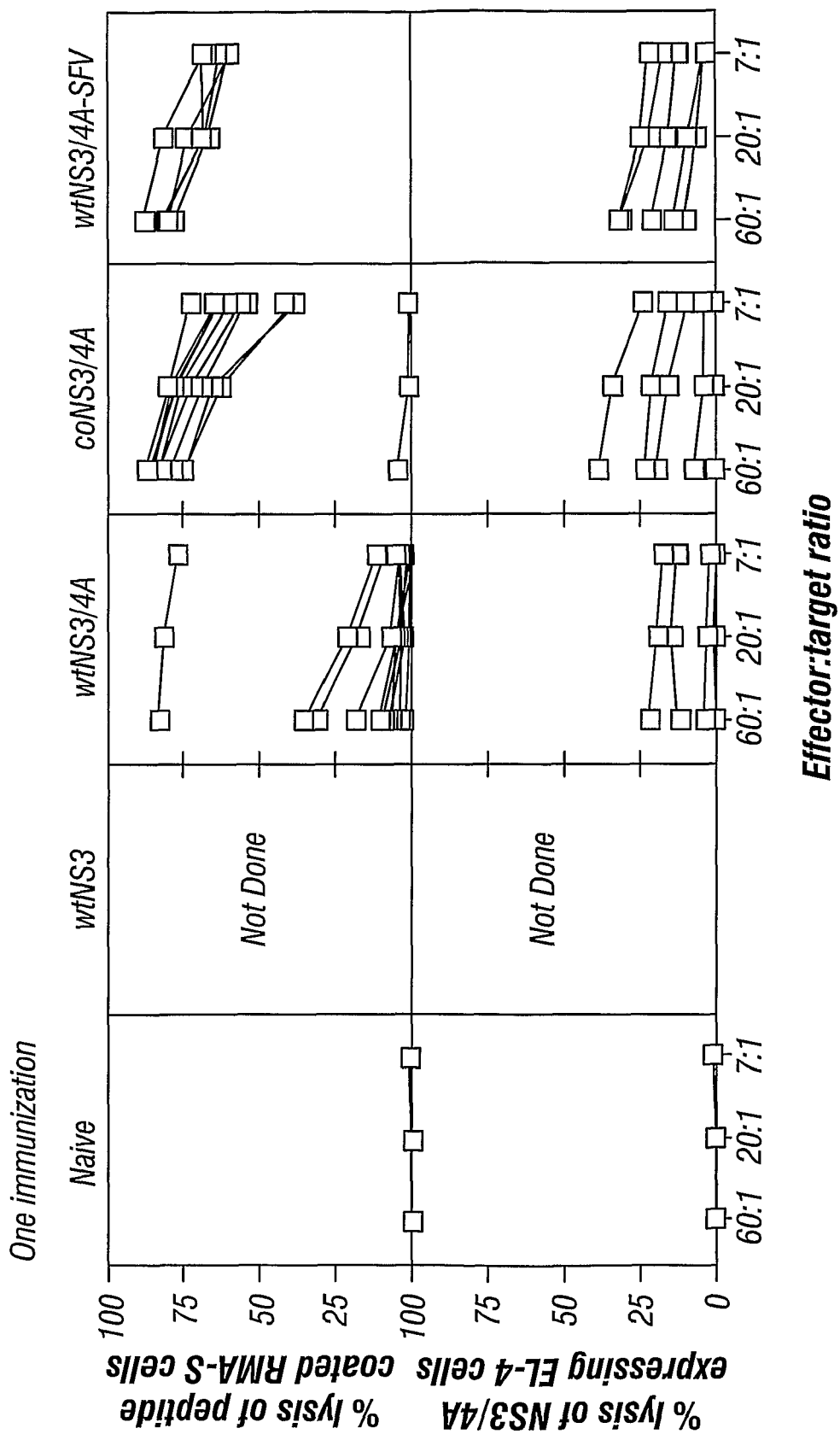
Figure 12B:
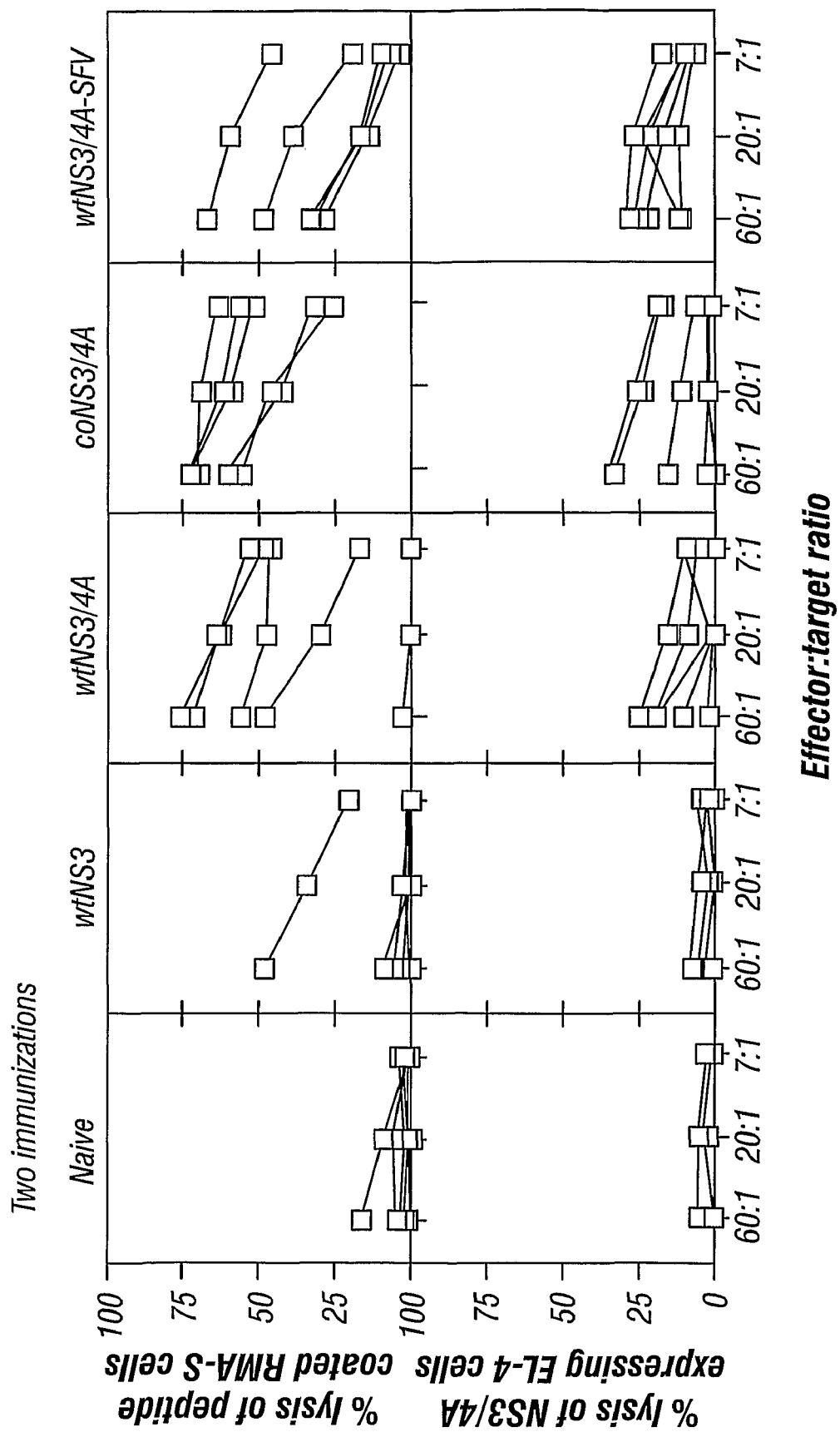

FIG. 12 shows the priming of in vitro detectable CTLs in H-2$^b$ mice by gene gun immunization of the wtNS3-pVAX1, wtNS3/4A, and coNS3/4A plasmids, or s.c. injection of wtNS3/4A-SFV particles. Groups of five to 10 H-2$^b$ mice were immunized once (a) or twice (b). The percent specific lysis corresponds to the percent lysis obtained with either NS3-peptide coated RMA-S cells (upper panel in (a) and (b)) or NS3/4A-expressing EL-4 cells (lower panel in a and b) minus the percent lysis obtained with unloaded or non-transfected EL-4 cells. Values have been given for effector to target (E:T) cell ratios of 60:1, 20:1 and 7:1. Each line indicates an individual mouse.

Figure 13A:
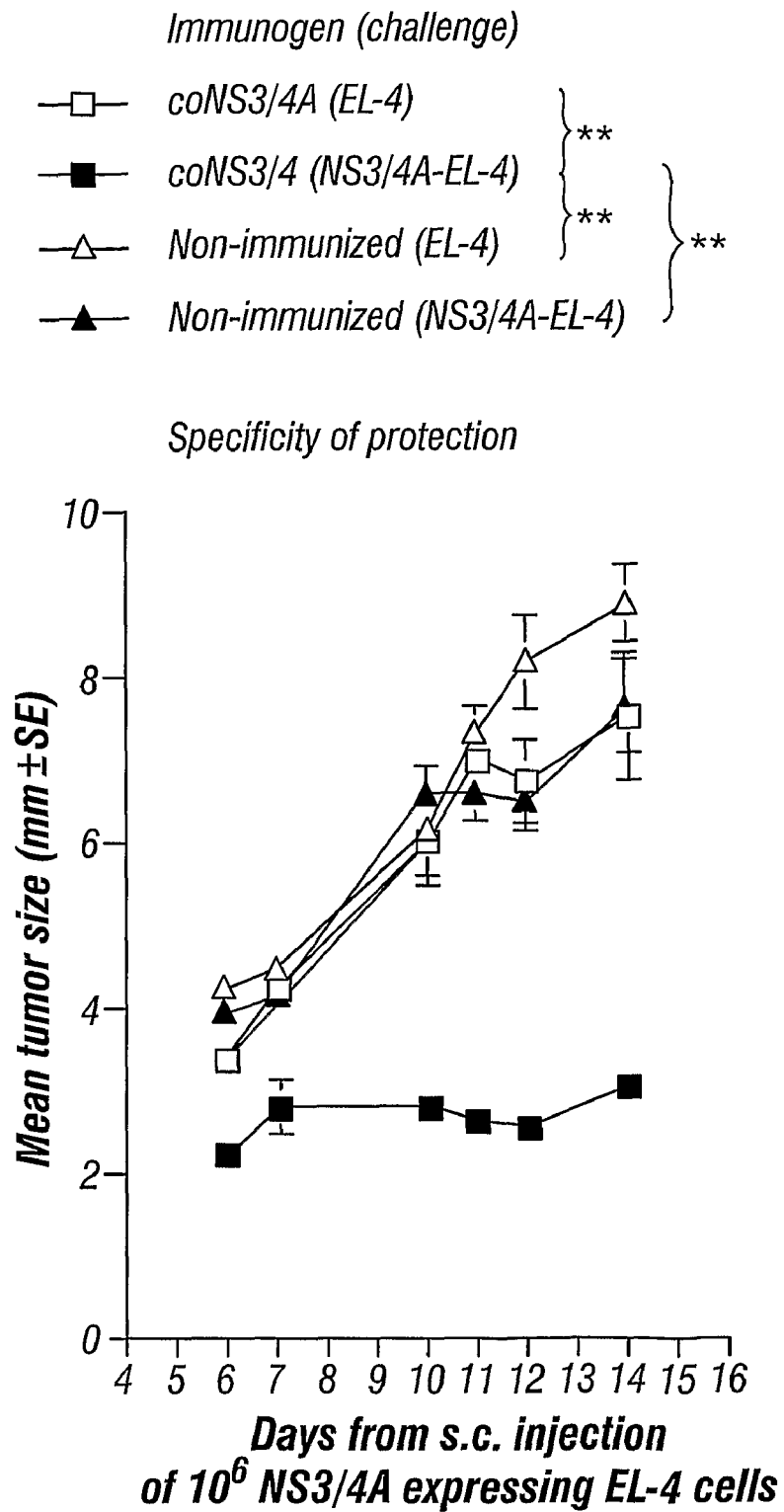
Figure 13B:
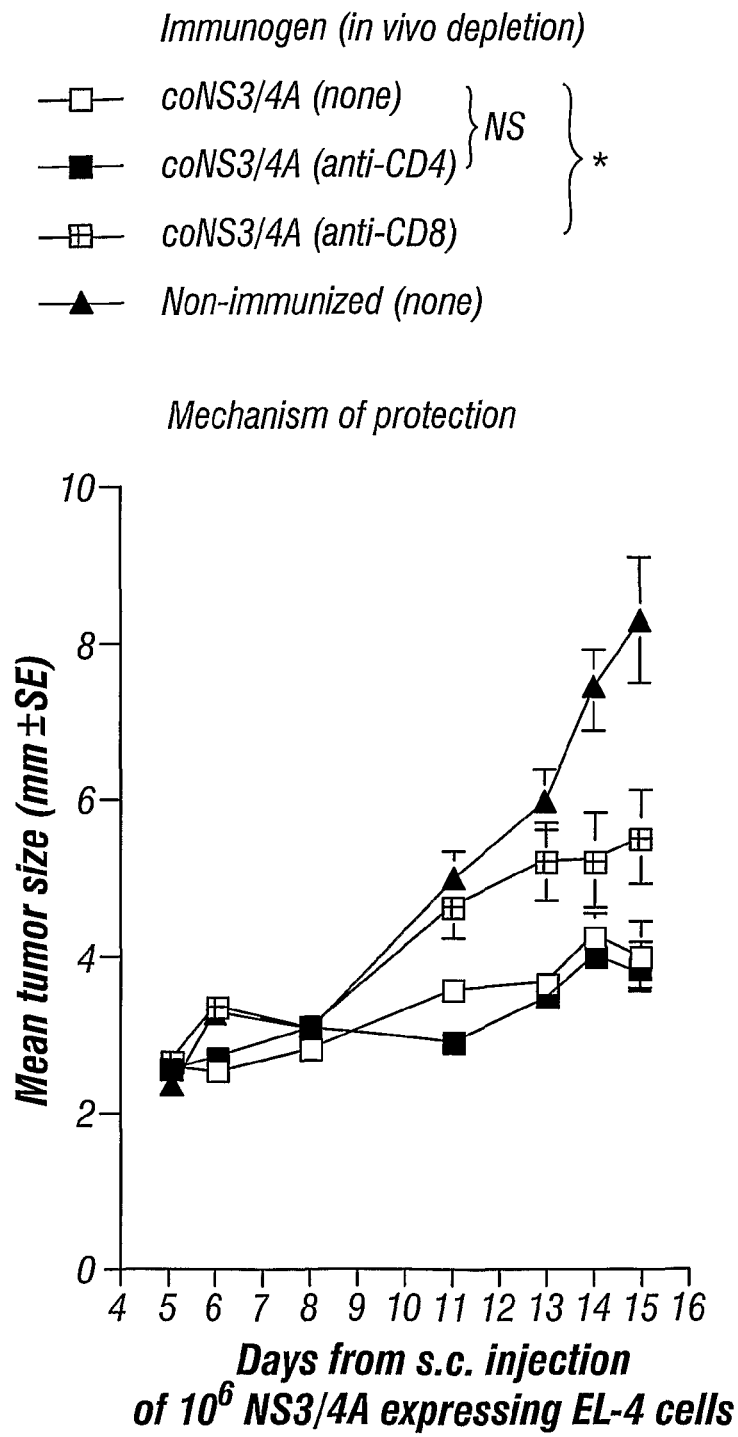

FIG. 13 shows the specificity of tumor inhibiting immune responses primed by gene gun immunization (panel (a)). Groups of ten C57BL/6 mice were either left untreated or were given two monthly immunizations with 4 μg of coNS3/4A-pVAX1. Two weeks after last immunization, mice were injected sub cutaneously with the parental EL-4 cell line or 10$^6$ NS3/4A-expressing EL-4 cells. Tumor sizes were measured through the skin at days 6, 7, 10, 11, 12, and 14 after tumour injection. In (b) the in vivo functional effector cell population was determined in groups of 10 C57BL/6 mice immunized twice with the coNS3/4A-pVAX1 plasmid using gene gun. In two groups either CD4+ or CD8+ T cells were depleted by administration of monoclonal antibodies one week prior to, and during, challenge with the NS3/4A-expressing EL-4 cell line. Tumor sizes were measured through the skin at days 5, 6, 8, 11, 13, 14, and 15 after tumour injection. Values have been given as the mean tumor size±standard error. A "**" sign indicates a statistical difference of $p<0.01$, a "*" sign indicates a difference of $p<0.05$, and NS (not significant) indicates no statistical difference (area under the curve values compared by ANOVA).

Figure 14:
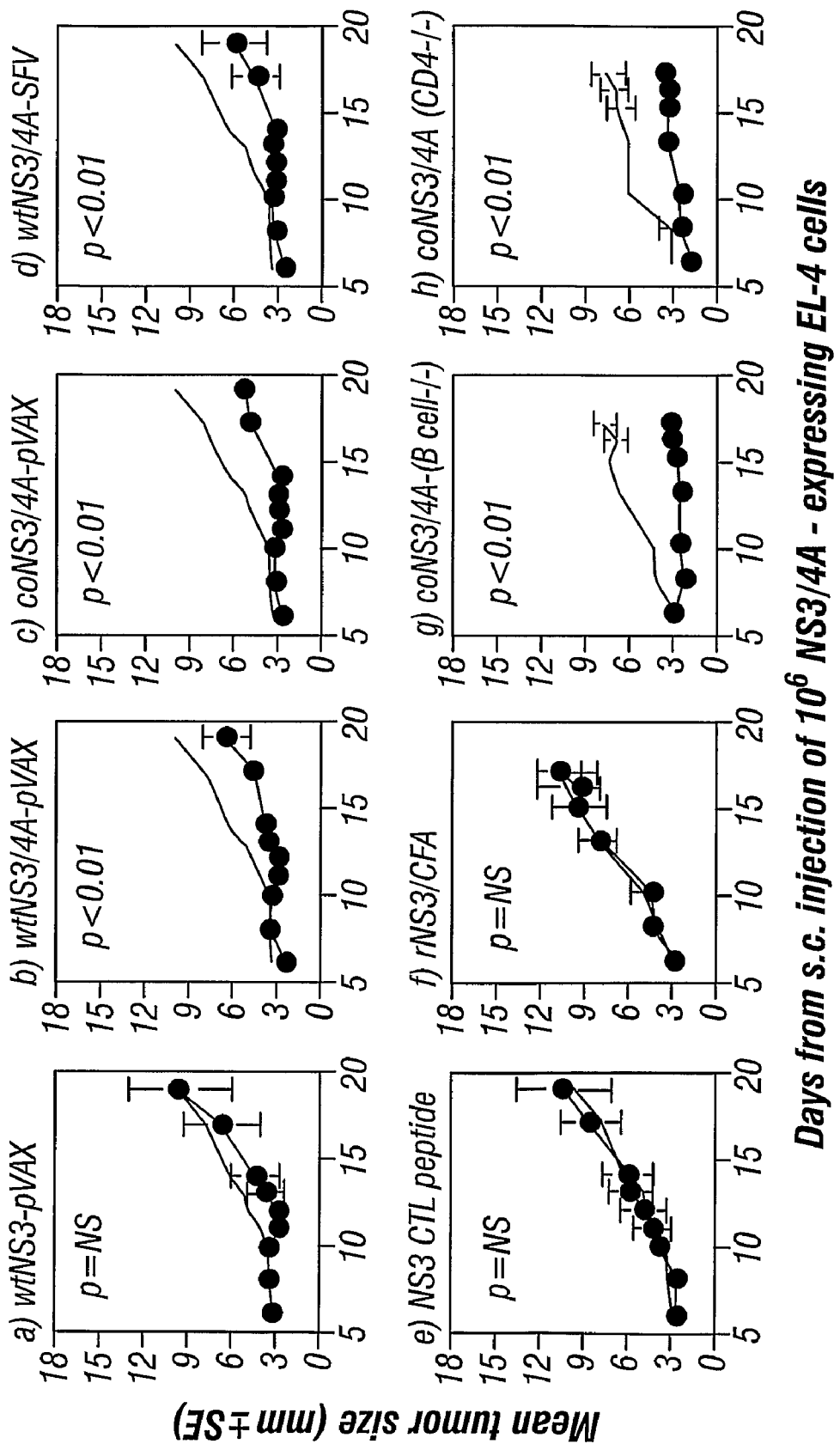

FIG. 14 shows an evaluation of the ability of different immunogens to prime HCV NS3/4A-specific tumor-inhibiting responses after a single immunization. Groups of ten C57BL/6 mice were either left untreated or were given one immunization with the indicated immunogen (4 μg DNA using gene gun in (a), (b), (c), (g), and (h); 10$^7$ SFV particles s.c. in d; 100 μg peptide in CFA s.c. in (e); and 20 μg rNS3 in CFA s.c. in (f). Two weeks after last immunization, mice were injected sub cutaneously with 10$^6$ NS3/4A-expressing EL-4 cells. Tumor sizes were measured through the skin at days 6 to 19 after tumor injection. Values have been given as the mean tumor size±standard error. In (a) to (e), as a negative control the mean data from the group immunized with the empty pVAX plasmid by gene gun has been plotted in each graph. In (f) to (h) the negative controls were non-immunized mice. Also given is the p value obtained from the statistical comparison of the control with each curve using the area under the curve and ANOVA.

Figure 15A:
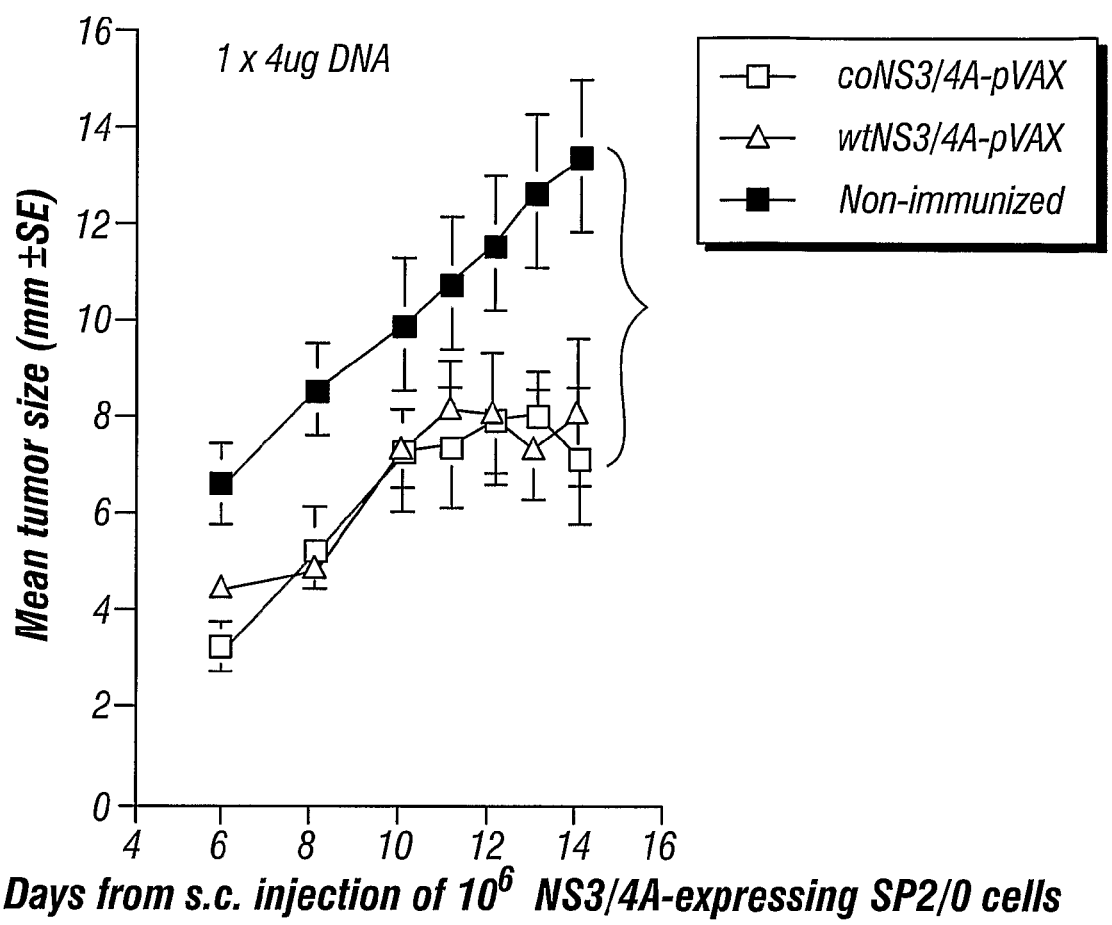
Figure 15B:
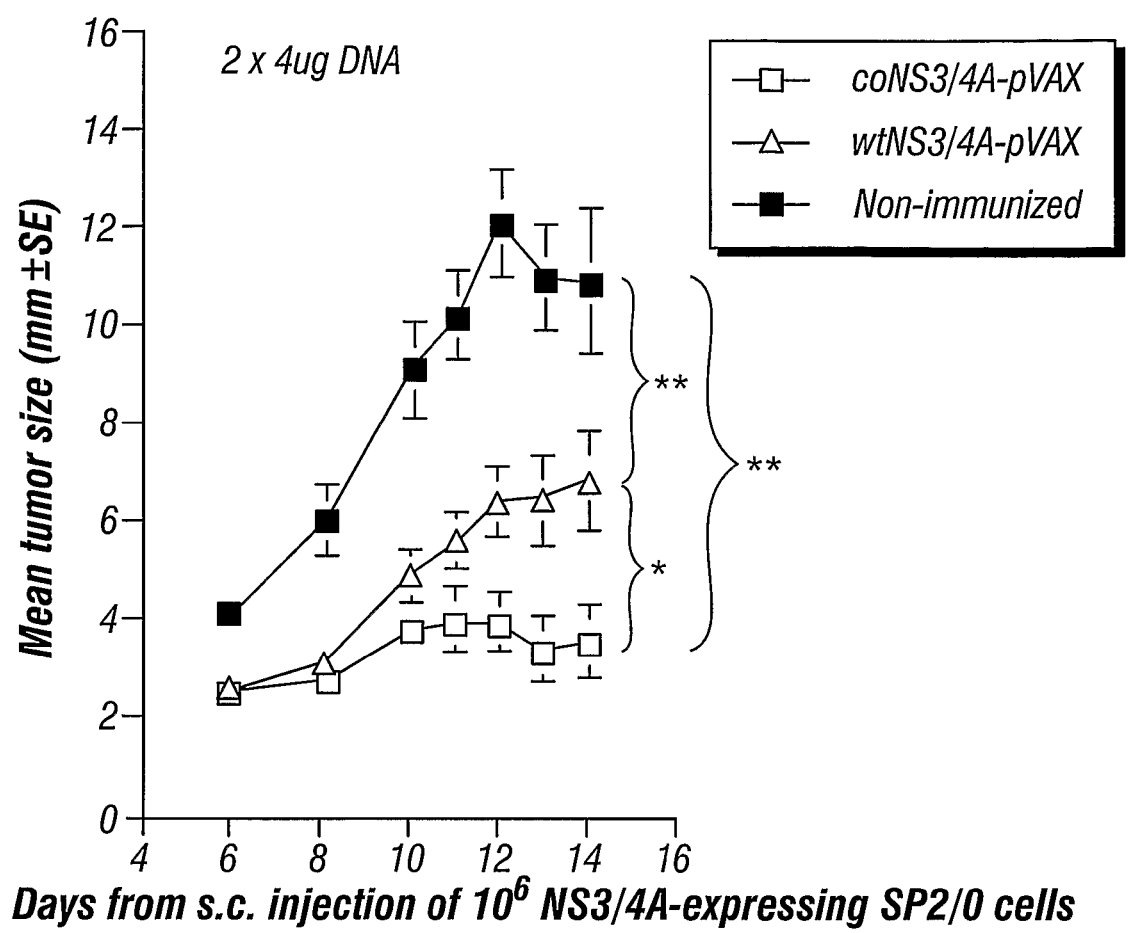
Figure 15C:
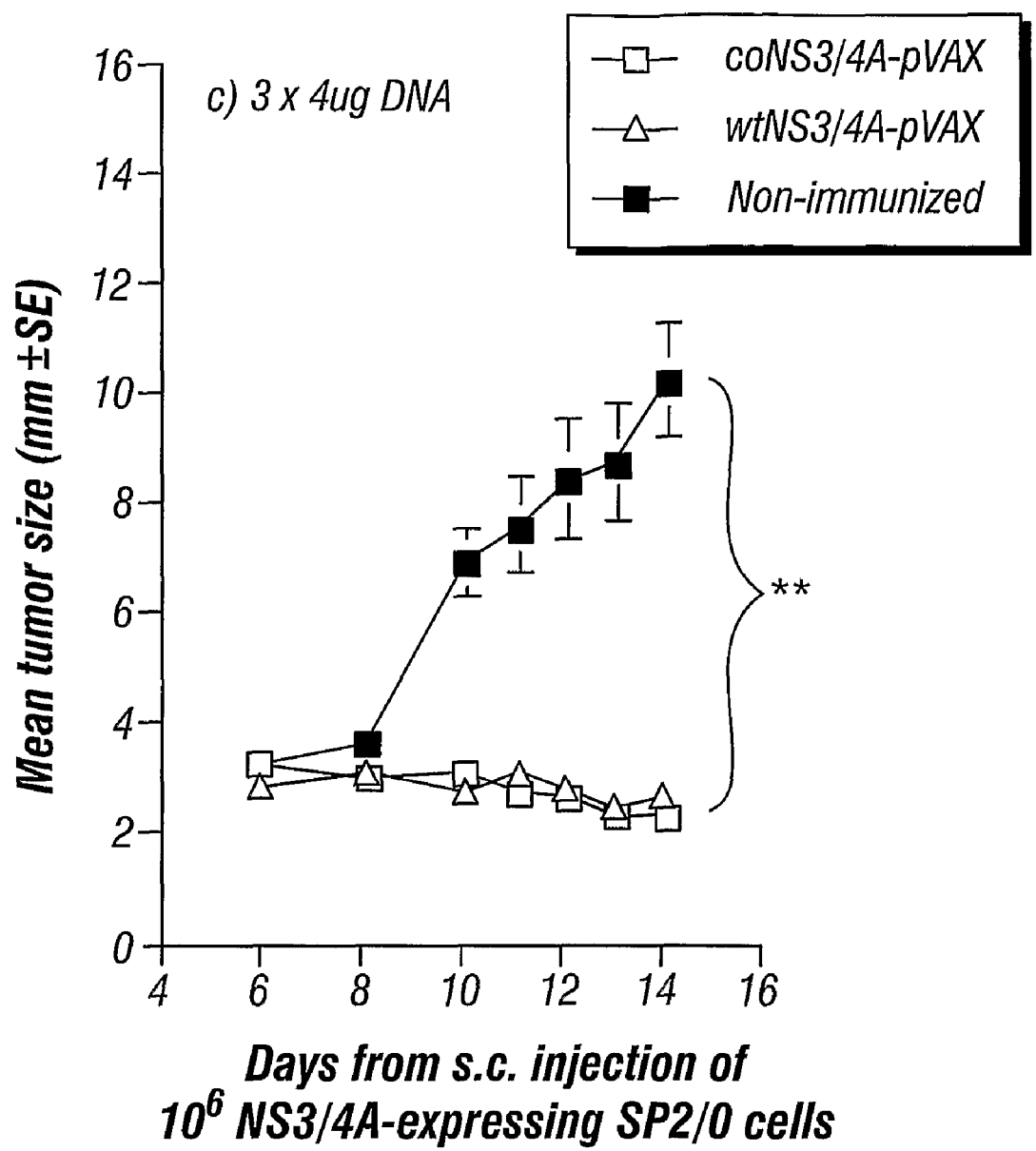

FIG. 15 shows the comparative efficiency of gene gun delivered wtNS3/4A-pVAX1 and coNS3/4A-pVAX1 plasmids in priming tumor inhibiting immune responses. Groups of ten BALB/c mice were either left untreated or were given one, two or three monthly immunisations with 4 μg of plasmid. Two weeks after last immunization, mice were injected sub cutaneously with 10$^6$ NS3/4A-expressing SP2/0 cells. Tumor sizes were measured through the skin at days 6, 8, 10, 11, 12, 13, and 14 after tumor injection. Values have been given as the mean tumor size±standard error. A "**" sign indicates a statistical difference of $p<0.01$, a "*" sign indicates a difference of $p<0.05$, and NS (not significant) indicates no statistical difference (area under the curve values compared by ANOVA).

Figure 16:
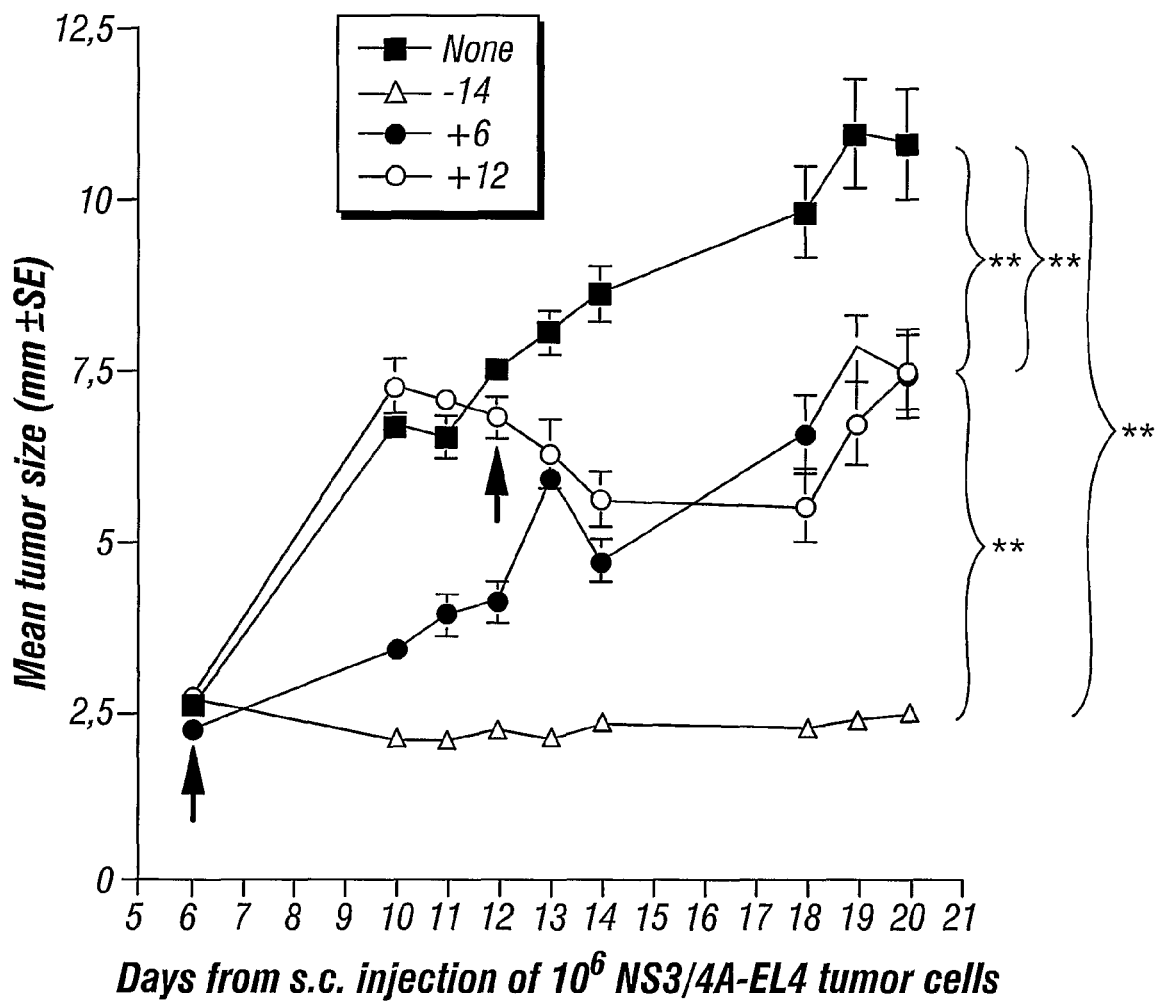

FIG. 16 shows the effect of therapeutic vaccination with the coNS3/4A plasmid using the gene gun. Groups of ten C57BL/6 mice were inoculated with 10$^6$ NS3/4A-EL4 cells. One group had been immunized once with 4 μg coNS3/4A DNA using a gene gun two weeks prior to challenge (positive control), one group was immunized the same way six days after tumor inoculation, and one group was immunized 12 days after tumor inoculation. One group was not immunized (negative control). Tumor sizes were measured through the skin at days 6, 10, 11, 12, 13, 14, 18, 19, and 20 after tumour injection. Values have been given as the mean tumor size±standard error. A "**" sign indicates a statistical difference of $p<0.01$, a "*" sign indicates a difference of $p<0.05$, and NS (not significant) indicates no statistical difference (area under the curve values compared by ANOVA).

FIG. 17 shows the location of amino acid residues in the NS3A protease that affect protease cleavage. Versions of NS3/NS4A-pVAX were constructed to encode proteins in which each amino acid of the shown sequence other than the alanine residues was substituted with an alanine residue. Each alanine residue was substituted with a glycine residue. The encoded proteins were analyzed for protease activity. The amino acids without a background are the 16 mutations which resulted in a protein that lacked all protease activity. The amino acids with the cross-hatched background are the 3 mutations which resulted in a protein that exhibited greatly enhanced protease activity compared to wtNS3/NS4A.

DETAILED DESCRIPTION OF THE INVENTION

A novel nucleic acid and protein corresponding to the NS3/4A domain of HCV was cloned from a patient infected with HCV (SEQ. ID. NO.: 1). A Genebank search revealed that the cloned sequence had the greatest homology to HCV sequences but was only 93% homologous to the closest HCV relative (accession no AJ 278830). This novel peptide (SEQ. ID. NO.: 2) and fragments thereof (e.g., SEQ. ID. NOs.: 14 and 15) that are any number of consecutive amino acids between at least 3-50 (e.g., 3, 4, 6, 8, 10, 12, 15, 20, 25, 30, 35, 40, 45, or 50 amino acids in length), nucleic acids encoding these molecules, vectors having said nucleic acids, and cells having said vectors, nucleic acids, or peptides are embodiments of the invention. It was also discovered that both the NS3/4A gene (SEQ. ID. NO.: 1) and corresponding peptide (SEQ. ID. NO.: 2) were immunogenic in vivo.

Mutants of the novel NS3/4A peptide were created. It was discovered that truncated mutants (e.g., SEQ. ID. NOs.: 12 and 13) and mutants that lack a proteolytic cleavage site (SEQ. ID. NOs.: 3-11), were also immunogenic in vivo. These novel peptides (SEQ. ID. NOs.: 3-13) and fragments thereof (e.g., SEQ. ID. NOs.: 16-26) that are any number of consecutive amino acids between at least 3-50 (e.g., 3, 4, 6, 8, 10, 12, 15, 20, 25, 30, 35, 40, 45, or 50 amino acids in length), nucleic acids encoding these molecules, vectors having said nucleic acids, and cells having said vectors, nucleic acids, or peptides are also embodiments of the invention.

A codon-optimized nucleic acid encoding NS3/4a was also created and was found to be immunogenic. The nucleic acid of SEQ. ID. NO.: 1 was analyzed for codon usage and the sequence was compared to the codons that are most commonly used in human cells. Because HCV is a human pathogen, it was unexpected to discover that the virus had not yet evolved to use codons that are most frequently found to encode human proteins (e.g., optimal human codons). A total of 435 nucleotides were replaced to generate the codon-optimized synthetic NS3/4A nucleic acid. The NS3/4A peptide encoded by the codon-optimized nucleic acid sequence (SEQ. ID. NO.: 36) was 98% homologous to HCV-1 and contained a total of 15 different amino acids.

The codon optimized nucleic acid (MSLF1 or coNS3/4A) (SEQ. ID. NO.: 35) was found to be more efficiently translated in vitro than the native NS3/4A and that mice immunized with the MSLF1 containing construct generated significantly more NS3/4A specific antibodies than mice immunized with a wild-type NS3/4A containing construct. Further, mice immunized with the MSLF1 containing construct were found to prime NS3-specific CTLs more effectively and exhibit better in vivo tumor inhibiting immune responses than mice immunized with wild-type NS3/4A containing constructs.

NS3/NS4A genes encoding polypeptides with alanine or glycine substitutions in the serine protease domain of NS3 (i.e., the first 181 amino acids) (SEQ ID NO's: 40 through 221) were found to have altered protease activity compared to the wtNS3/NS4A polypeptide.

The peptides and nucleic acids described above are useful as immunogens, which can be administered alone or in conjunction with an adjuvant. Preferred embodiments include compositions that comprise one or more of the nucleic acids and/or peptides described above with or without an adjuvant. That is, some of the compositions described herein are prepared with or without an adjuvant and comprise, consist, or consist essentially of a NS3/4A peptide (SEQ. ID. NO.: 2 or SEQ. ID. NO.: 36) or fragments thereof that are any number of consecutive amino acids between at least 3-50 (e.g., 3, 4, 6, 8, 10, 12, 15, 20, 25, 30, 35, 40, 45, or 50 amino acids in length) (e.g., SEQ. ID. NOs.: 14 and 15) or a nucleic acid encoding one or more of these molecules (e.g., SEQ. ID. NO.: 35) or a fragment thereof that is any number of consecutive nucleotides between at least 12-2112 (e.g., 12-15, 15-20, 20-30, 30-50, 50-100, 100-200, 200-500, 500-1000, 1000-1500, 1500-2079, or 1500-2112 consecutive nucleotides in length), or. Additional compositions are prepared with or without an adjuvant and comprise, consist, or consist essentially of one or more of the NS3/4A mutant peptides (SEQ. ID. NOs.: 3-13) and fragments thereof that are any number of consecutive amino acids between at least 3-50 (e.g., 3, 4, 6, 8, 10, 12, 15, 20, 25, 30, 35, 40, 45, or 50 amino acids in length). Some of the compositions described herein are prepared with or without an adjuvant and comprise, consist, or consist essentially of a mutant NS3/NS4A peptide (e.g., SEQ ID NO: 40 through SEQ ID NO:221), or a nucleic acid encoding one or more of these molecules.

It was also discovered that compositions comprising ribavirin and an antigen (e.g., one or more of the previously described HCV peptides or nucleic acids) enhance and/or facilitate an animal's immune response to the antigen. That is, it was discovered that ribavirin is a very effective "adjuvant," which for the purposes of this disclosure, refers to a material that has the ability to enhance or facilitate an immune response to a particular antigen. The adjuvant activity of ribavirin was manifested by a significant increase in immune-mediated protection against the antigen, an increase in the titer of antibody raised to the antigen, and an increase in proliferative T cell responses.

Accordingly, compositions (e.g., vaccines and other medicaments) that comprise ribavirin and one or more of the peptides or nucleic acids described herein are embodiments of the invention. These compositions can vary according to the amount of ribavirin, the form of ribavirin, as well as the sequence of the HCV nucleic acid or peptide.

Embodiments of the invention also include methods of making and using the compositions above. Some methods involve the making of nucleic acids encoding NS3/4A, codon-optimized NS3/4A, mutant NS34A, fragments thereof that are any number of consecutive nucleotides between at least 9-100 (e.g., 9, 12, 15, 18, 21, 24, 27, 30, 50, 60, 75, 80, 90, or 100 consecutive nucleotides in length), peptides corresponding to said nucleic acids, constructs comprising said nucleic acids, and cells containing said compositions. Preferred methods, however, concern the making of vaccine compositions or immunogenic preparations that comprise, consist, or consist essentially of the newly discovered NS3/4A fragment, codon-optimized NS3/4A, or an NS3/4A mutant (e.g., a truncated mutant, a mutant lacking a proteolytic cleavage site, or a mutant having altered protease activity), or a fragment thereof or a nucleic acid encoding one or more of these molecules, as described above. Preferred fragments for use with the methods described herein include SEQ. ID. NOs.: 12-27 and fragments of SEQ. ID. NO.: 35 that contain at least 30 consecutive nucleotides. The compositions described above can be made by providing an adjuvant (e.g., ribavirin), providing an HCV antigen (e.g., a peptide comprising an HCV antigen such as (SEQ. ID. NOs.: 2-11, 36, or 40-220) or a fragment thereof such as, SEQ. ID. NOs.: 12-26 or a nucleic acid encoding one or more of said peptides), and mixing said adjuvant and said antigen so as to formulate a composition that can be used to enhance or facilitate an immune response in a subject to said antigen.

Methods of enhancing or promoting an immune response in an animal, including humans, to an antigen are also provided. Such methods can be practiced, for example, by identifying an animal in need of an immune response to HCV and providing said animal a composition comprising one or more of the nucleic acids or peptides above and an amount of adjuvant that is effective to enhance or facilitate an immune response to the antigen/epitope. In some embodiments, the antigen and the adjuvant are administered separately, instead of in a single mixture. Preferably, in this instance, the adjuvant is administered a short time before or a short time after administering the antigen. Preferred methods involve providing the animal in need with ribavirin and NS3/4A (e.g., SEQ. ID. NO.: 2), codon-optimized NS3/4A (e.g., SEQ. ID. NO.: 36), a mutant NS3/4A (e.g., SEQ. ID. NOs.: 3-13 or 40-220), a fragment thereof (e.g., SEQ. ID. NOs.: 14-26) containing any number of consecutive amino acids between at least 3-50 (e.g., 3, 4, 6, 8, 10, 12, 15, 20, 25, 30, 35, 40, 45, or 50 amino acids in length) or a nucleic acid encoding any one or more of said molecules.

Other embodiments concern methods of treating and preventing HCV infection. By one approach, an immunogen comprising one or more of the HCV nucleic acids or peptides described herein are used to prepare a medicament for the treatment and/or prevention of HCV infection. By another approach, an individual in need of a medicament that prevents and/or treats HCV infection is identified and said individual is provided a medicament comprising ribavirin and an HCV antigen such as NS3/4A (e.g., SEQ. ID. NO.: 2), codon-optimized NS3/4A (e.g., SEQ. ID. NO.: 36), or a mutant NS3/4A (e.g., SEQ. ID. NOs.: 3-13 or 40-220), a fragment thereof (e.g., SEQ. ID. NOs.: 14-26) containing any number of consecutive amino acids between at least 3-50 (e.g., 3, 4, 6, 8, 10, 12, 15, 20, 25, 30, 35, 40, 45, or 50 amino acids in length) or a nucleic acid encoding any one or more of these molecules.

The section below discusses the discovery of the novel NS3/4A gene, the codon-optimized NS3/4A gene, the creation of the NS3/4A mutants, and the characterization of the nucleic acids and peptides corresponding thereto.

NS3/4A, NS3/4A Mutants, and Codon-Optimized NS3/4A

A novel nucleic acid and protein corresponding to the NS3/4A domain of HCV was cloned from a patient infected with HCV (SEQ. ID. NOs.: 1 and 2). A Genebank search revealed that the cloned sequence had the greatest homology to HCV sequences but was only 93% homologous to the closest HCV relative (accession no AJ 278830). A truncated mutant of the novel NS3/4A peptide and NS3/4A mutants, which lack a proteolytic cleavage site, (as well as corresponding nucleic acids) were also created. Further, a human codon-optimized NS3/4A nucleic acid and peptide were created. It was discovered that these novel peptides and nucleic acids encoding said peptides were potent immunogens that can be mixed with adjuvants so as to make a composition that induces a recipient to provide an immune response to HCV. The cloning of the novel NS3/4A gene and the creation of the various NS3/4A mutants and codon optimized NS3/4A gene are described in the following example.

Example 1

The NS3/4A sequence was amplified from the serum of an HCV-infected patient (HCV genotype 1a) using the Polymerase Chain Reaction (PCR). Total RNA was extracted from serum, and cDNA synthesis and PCR were performed according to standard protocols (Chen M et al., *J. Med. Virol.* 43:223-226 (1995)). The cDNA synthesis was initiated using the antisense primer "NS4KR" (5'-CCG TCT AGA TCA GCA CTC TTC CAT TTC ATC-3' (SEQ. ID. NO.: 28)). From this cDNA, a 2079 base pair DNA fragment of HCV, corresponding to amino acids 1007 to 1711, which encompasses the NS3 and NS4A genes, was amplified. A high fidelity polymerase (Expand High Fidelity PCR, Boehringer-Mannheim, Mannheim, Germany) was used with the "NS3KF" primer (5'-CCT GAA TTC ATG GCG CCT ATC ACG GCC TAT-3' (SEQ. ID. NO.: 29) and the NS4KR primer. The NS3KF primer contained a EcoRI restriction enzyme cleavage site and a start codon and the primer NS4KR contained a XaI restriction enzyme cleavage site and a stop codon.

The amplified fragment was then sequenced (SEQ. ID. NO.: 1). Sequence comparison analysis revealed that the gene fragment was amplified from a viral strain of genotype 1a. A computerized BLAST search against the Genbank database using the NCBI website revealed that the closest HCV homologue was 93% identical in nucleotide sequence.

The amplified DNA fragment was then digested with EcoRI and XbaI, and was inserted into a pcDNA3.1/His plasmid (Invitrogen) digested with the same enzymes. The NS3/4A-pcDNA3.1 plasmid was then digested with EcoRI and Xba I and the insert was purified using the QiaQuick kit (Qiagen, Hamburg, Germany) and was ligated to a EcoRI/Xba I digested pVAX vector (Invitrogen) so as to generate the NS3/4A-pVAX plasmid.

The rNS3 truncated mutant was obtained by deleting NS4A sequence from the NS3/4A DNA. Accordingly, the NS3 gene sequence of NS3/4A-pVAX was PCR amplified using the primers NS3KF and 3'NotI (5'-CCA CGC GGC CGC GAC GAC CTA CAG-3' (SEQ. ID. NO.: 30)) containing EcoRI and Not I restriction sites, respectively. The NS3 fragment (1850 bp) was then ligated to a EcoRI and Not I digested pVAX plasmid to generate the NS3-pVAX vector. Plasmids were grown in BL21 *E. coli* cells. The plasmids were sequenced and were verified by restriction cleavage and the results were as to be expected based on the original sequence.

Table 1 describes the sequence of the proteolytic cleavage site of NS3/4A, referred to as the breakpoint between NS3 and NS4A. This wild-type breakpoint sequence was mutated in many different ways so as to generate several different NS3/4A breakpoint mutants. Table 1 also identifies these mutant breakpoint sequences. The fragments listed in TABLE 1 are preferred immunogens that can be incorporated with or without an adjuvant (e.g., ribavirin) into a composition for administration to an animal so as to induce an immune response in said animal to HCV.

TABLE 1

| Plasmid | Deduced amino acid sequence |
| --- | --- |
| *NS3/4A-pVAX | TKYMTCMSADLEVV<u>TST</u>WVLVGGVL (SEQ. ID. NO.: 14) |
| NS3/4A-TGT-pVAX | TKYMTCMSADLEVV<u>TGT</u>WVLVGGVL (SEQ. ID. NO.: 16) |
| NS3/4A-RGT-pVAX | TKYMTCMSADLEVV<u>RGT</u>WVLVGGVL (SEQ. ID. NO.: 17) |
| NS3/4A-TPT-pVAX | TKYMTCMSADLEVV<u>TPT</u>WVLVGGVL (SEQ. ID. NO.: 18) |
| NS3/4A-RPT-pVAX | TKYMTCMSADLEVV<u>RPT</u>WVLVGGVL (SEQ. ID. NO.: 19) |
| NS3/4A-RPA-pVAX | TKYMTCMSADLEVV<u>RPA</u>WVLVGGVL (SEQ. ID. NO.: 20) |
| NS3/4A-CST-pVAX | TKYMTCMSADLEVV<u>CST</u>WVLVGGVL (SEQ. ID. NO.: 21) |
| NS3/4A-CCST-pVAX | TKYMTCMSADLEVC<u>CST</u>WVLVGGVL (SEQ. ID. NO.: 22) |
| NS3/4A-SSST-pVAX | TKYMTCMSADLEVS<u>SST</u>WVLVGGVL (SEQ. ID. NO.: 23) |
| NS3/4A-SSSSCST-pVAX | TKYMTCMSADSSSS<u>CST</u>WVLVGGVL (SEQ. ID. NO.: 24) |
| NS3A/4A-VVVVTST-pVAX | TKYMTCMSADVVVV<u>TST</u>WVLVGGVL (SEQ. ID. NO.: 25) |
| NS5-pVAX | ASEDVVC<u>CSM</u>SYTWTG (SEQ. ID. NO.: 27) |
| NS5A/B-pVAX | SSEDVVC<u>CSM</u>WVLVGGVL (SEQ. ID. NO.: 26) |

*The wild type sequence for the NS3/4A fragment is NS3/4A-pVAX. The NS3/4A breakpoint is identified by underline, wherein the P1 position corresponds to the first Thr (T) and the P1' position corresponds to the next following amino acid the NS3/4A-pVAX sequence. In the wild type NS3/4A sequence the NS3 protease cleaves between the P1 and P1' positions.

To change the proteolytic cleavage site between NS3 and NS4A, the NS3/4A-pVAX plasmid was mutagenized using the QUICKCHANGE™ mutagenesis kit (Stratagene), following the manufacturer's recommendations. To generate the "TPT" mutation, for example, the plasmid was amplified using the primers 5'-CTGGAGGTCGTCACGCCTAC-CTGGGTGCTCGTT-3' (SEQ. ID. NO.: 31) and 5'-AC-CGAGCACCCAGGTAGGCGTGACGACCTCCAG-3' (SEQ. ID. NO.: 32) resulting in NS3/4A-TPT-pVAX. To generate the "RGT" mutation, for example, the plasmid was amplified using the primers 5'-CTGGAGGTCGTCCGCGG-TACCTGGGTGCTCGTT-3' (SEQ. ID. NO.: 33) and 5'-AC-CGAGCACCCAGGTACC-GCGGACGACCTCCAG-3' (SEQ. ID. NO.: 34) resulting in NS3/4A-RGT-pVAX. All mutagenized constructs were sequenced to verify that the mutations had been correctly made. Plasmids were grown in competent BL21 E. coli.

The sequence of the previously isolated and sequenced unique NS3/4A gene (SEQ. ID. NO.: 1) was analyzed for codon usage with respect to the most commonly used codons in human cells. A total of 435 nucleotides were replaced to optimize codon usage for human cells. The sequence was sent to Retrogen Inc. (6645 Nancy Ridge Drive, San Diego, Calif. 92121) and they were provided with instructions to generate a full-length synthetic codon optimized NS3/4A gene. The codon optimized NS3/4A gene had a sequence homology of 79% within the region between nucleotide positions 3417-5475 of the HCV-1 reference strain. A total of 433 nucleotides differed. On an amino acid level, the homology with the HCV-1 strain was 98% and a total of 15 amino acids differed.

The full length codon optimized 2.1 kb DNA fragment of the HCV corresponding to the amino acids 1007 to 1711 encompassing the NS3 and NS4A NS3/NS4A gene fragment was amplified by the polymerase chain reaction (PCR) using high fidelity polymerase (Expand High Fidelity PCR, Boehringer-Mannheim, Mannheim, Germany). The amplicon was then inserted into a Bam HI and Xba I digested pVAX vector (Invitrogen, San Diego), which generated the MSLF1-pVAX (coNS3/4A-pVAX) plasmid. All expression constructs were sequenced. Plasmids were grown in competent BL21 *E. Coli*. The plasmid DNA used for in vivo injection was purified using Qiagen DNA purification columns, according to the manufacturers instructions (Qiagen GmbH, Hilden, FRG). The concentration of the resulting plasmid DNA was determined spectrophotometrically (Dynaquant, Pharmacia Biotech, Uppsala, Sweden) and the purified DNA was dissolved in sterile phosphate buffer saline (PBS) at concentrations of 1 mg/ml.

The expression of NS3 and NS3/4A proteins from the wtNS3/4A (wild-type NS3/4A) and coNS3/4A plasmids, were analyzed by an in vitro transcription and translation assay. The assay showed that the proteins could be correctly translated from the plasmids and that the coNS3/4A plasmid gave detectable NS3 and NS3/4A bands at a higher plasmid dilution as compared to the wtNS3/4A plasmid. This result provided strong evidence that the in vitro translation from the coNS3/4A plasmid is more effective than wtNS3/4A. To compare the expression levels more precisely, HepG2 cells were transiently transfected with the wtNS3/4A and the coNS3/4A plasmids. These experiments revealed that the coNS3/4A plasmid generated 11-fold higher expression levels of the NS3 protein when compared to the wtNS3/4A plasmid, as determined by densitometry and a standard curve of recombinant NS3. Since the wtNS3/4A and the coNS3/4A plasmids are identical in size it is unlikely that there would be any major differences in transfections efficiencies between the plasmids. Staining of coNS3/4A plasmid transfected, and SFV infected, BHK cells revealed a similar perinuclear and cytoplasmic distribution of the NS3 as previously observed, confirming an unchanged subcellular localization.

Several nucleic acid embodiments include nucleotides encoding the HCV peptides described herein (SEQ. ID. NOs.: 2-11 or SEQ. ID. NO.: 36) or a fragment thereof (e.g., SEQ. ID. NOs.: 14 and 15) containing any number of consecutive amino acids between at least 3-50 (e.g., 3, 4, 6, 8, 10, 12, 15, 20, 25, 30, 35, 40, 45, or 50 amino acids in length). Some embodiments for example, include genomic DNA, RNA, and cDNA encoding these HCV peptides. The HCV nucleotide embodiments not only include the DNA sequences shown in the sequence listing (e.g., SEQ. ID. NO.: 1 or SEQ. ID. NO.: 35) but also include nucleotide sequences encoding the amino acid sequences shown in the sequence listing (e.g., SEQ. ID. NOs.: 2-11 or SEQ. ID. NO.: 36) and any nucleotide sequence that hybridizes to the DNA sequences shown in the sequence listing under stringent conditions (e.g., hybridization to filter-bound DNA in 0.5 M $NaHPO_4$, 7.0% sodium dodecyl sulfate (SDS), 1 mM EDTA at 50° C.) and washing in 0.2×SSC/0.2% SDS at 50° C. and any nucleotide sequence that hybridizes to the DNA sequences that encode an amino acid sequence provided in the sequence listing (SEQ. ID. NOs.: 2-11 or SEQ. ID. NO.: 36) under less stringent conditions (e.g., hybridization in 0.5 M $NaHPO_4$, 7.0% sodium dodecyl sulfate (SDS), 1 mM EDTA at 37° C. and washing in 0.2×SSC/0.2% SDS at 37° C.).

The nucleic acid embodiments of the invention also include fragments, modifications, derivatives, and variants of the sequences described above. Desired embodiments, for example, include nucleic acids having at least 25 consecutive bases of one of the novel HCV sequences or a sequence complementary thereto and preferred fragments include at least 25 consecutive bases of a nucleic acid encoding the NS3/4A molecule of SEQ. ID. NO.: 2 or SEQ. ID. NO.: 36 or a mutant NS3/4A molecule of SEQ. ID. NOs.: 3-13 or a sequence complementary thereto.

In this regard, the nucleic acid embodiments described herein can have any number of consecutive nucleotides between about 12 to approximately 2112 consecutive nucleotides of SEQ. ID. NO.: 1 or SEQ. ID. NO.: 35. Some DNA fragments, for example, include nucleic acids having at least 12-15, 15-20, 20-30, 30-50, 50-100, 100-200, 200-500, 500-1000, 1000-1500, 1500-2079, or 1500-2112 consecutive nucleotides of SEQ. ID. NO.: 1 or SEQ. ID. NO.: 35 or a complement thereof. These nucleic acid embodiments can also be altered by substitution, addition, or deletion so long as the alteration does not significantly affect the structure or function (e.g., ability to serve as an immunogen) of the HCV nucleic acid. Due to the degeneracy of nucleotide coding sequences, for example, other DNA sequences that encode substantially the same HCV amino acid sequence as depicted in SEQ. ID. NOs.: 2-13 or SEQ. ID. NO.: 36 can be used in some embodiments. These include, but are not limited to, nucleic acid sequences encoding all or portions of HCV peptides (SEQ. ID. NOs.: 2-13) or nucleic acids that complement all or part of this sequence that have been altered by the substitution of different codons that encode a functionally equivalent amino acid residue within the sequence, thus producing a silent change, or a functionally non-equivalent amino acid residue within the sequence, thus producing a detectable change. Accordingly, the nucleic acid embodiments of the invention are said to be comprising, consisting of, or consisting essentially of nucleic acids encoding any one of SEQ. ID. NOs.: 2-27 or SEQ. ID. NO.: 36 in light of the modifications above.

By using the nucleic acid sequences described above, probes that complement these molecules can be designed and manufactured by oligonucleotide synthesis. Desirable probes comprise a nucleic acid sequence of (SEQ. ED. NO.: 1) that is unique to this HCV isolate. These probes can be used to screen cDNA from patients so as to isolate natural sources of HCV, some of which may be novel HCV sequences in themselves. Screening can be by filter hybridization or by PCR, for example. By filter hybridization, the labeled probe preferably contains at least 15-30 base pairs of the nucleic acid sequence of (SEQ. ID. NO.: 1) that is unique to this NS3/4A peptide. The hybridization washing conditions used are preferably of a medium to high stringency. The hybridization can be performed in 0.5M $NaHPO_4$, 7.0% sodium dodecyl sulfate (SDS), 1 mM EDTA at 42° C. overnight and washing can be performed in 0.2×SSC/0.2% SDS at 42° C. For guidance regarding such conditions see, for example, Sambrook et al., 1989, *Molecular Cloning, A Laboratory Manual*, Cold Springs Harbor Press, N.Y.; and Ausubel et al., 1989, *Current Protocols in Molecular Biology*, Green Publishing Associates and Wiley Interscience, N.Y.

HCV nucleic acids can also be isolated from patients infected with HCV using the nucleic acids described herein. (See also Example 1). Accordingly, RNA obtained from a patient infected with HCV is reverse transcribed and the resultant cDNA is amplified using PCR or another amplification technique. The primers are preferably obtained from the NS3/4A sequence (SEQ. ID. NO.: 1).

For a review of PCR technology, see Molecular Cloning to Genetic Engineering White, B. A. Ed. in *Methods in Molecular Biology* 67: Humana Press, Totowa (1997) and the publication entitled "PCR Methods and Applications" (1991, Cold Spring Harbor Laboratory Press). For amplification of mRNAs, it is within the scope of the invention to reverse transcribe mRNA into cDNA followed by PCR (RT-PCR); or, to use a single enzyme for both steps as described in U.S. Pat. No. 5,322,770. Another technique involves the use of Reverse Transcriptase Asymmetric Gap Ligase Chain Reaction (RT-AGLCR), as described by Marshall R. L. et al. (*PCR Methods and Applications* 4:80-84, 1994).

Briefly, RNA is isolated, following standard procedures. A reverse transcription reaction is performed on the RNA using an oligonucleotide primer specific for the most 5' end of the amplified fragment as a primer of first strand synthesis. The resulting RNA/DNA hybrid is then "tailed" with guanines using a standard terminal transferase reaction. The hybrid is then digested with RNAse H, and second strand synthesis is primed with a poly-C primer. Thus, cDNA sequences upstream of the amplified fragment are easily isolated. For a review of cloning strategies which can be used, see e.g., Sambrook et al., 1989, supra.

In each of these amplification procedures, primers on either side of the sequence to be amplified are added to a suitably prepared nucleic acid sample along with dNTPs and a thermostable polymerase, such as Taq polymerase, Pfu polymerase, or Vent polymerase. The nucleic acid in the sample is denatured and the primers are specifically hybridized to complementary nucleic acid sequences in the sample. The hybridized primers are then extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188.

The primers are selected to be substantially complementary to a portion of the nucleic acid sequence of (SEQ. ID. NO.: 1) that is unique to this NS3/4A molecule, thereby allowing the sequences between the primers to be amplified. Preferably, primers can be any number between at least 16-20, 20-25, or 25-30 nucleotides in length. The formation of stable hybrids depends on the melting temperature (Tm) of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers described herein preferably range between 10% and 75%, more preferably between 35% and 60%, and most preferably between 40% and 55%. The appropriate length for primers under a particular set of assay conditions can be empirically determined by one of skill in the art.

The spacing of the primers relates to the length of the segment to be amplified. In the context of the embodiments described herein, amplified segments carrying nucleic acid sequence encoding HCV peptides can range in size from at least about 25 bp to the entire length of the HCV genome. Amplification fragments from 25-1000 bp are typical, fragments from 50-1000 bp are preferred and fragments from 100-600 bp are highly preferred. It will be appreciated that amplification primers can be of any sequence that allows for specific amplification of the NS3/4A region and can, for example, include modifications such as restriction sites to facilitate cloning.

The PCR product can be subcloned and sequenced to ensure that the amplified sequences represent the sequences of an HCV peptide. The PCR fragment can then be used to isolate a full length cDNA clone by a variety of methods. For example, the amplified fragment can be labeled and used to screen a cDNA library, such as a bacteriophage cDNA library. Alternatively, the labeled fragment can be used to isolate genomic clones via the screening of a genomic library. Additionally, an expression library can be constructed utilizing cDNA synthesized from, for example, RNA isolated from an infected patient. In this manner, HCV geneproducts can be isolated using standard antibody screening techniques in conjunction with antibodies raised against the HCV gene product. (For screening techniques, see, for example, Harlow, E. and Lane, eds., 1988, *Antibodies: A Laboratory Manual*, Cold Spring Harbor Press, Cold Spring Harbor).

Embodiments of the invention also include (a) DNA vectors that contain any of the foregoing nucleic acid sequence and/or their complements (i.e., antisense); (b) DNA expression vectors that contain any of the foregoing nucleic acid sequences operatively associated with a regulatory element that directs the expression of the nucleic acid; and (c) genetically engineered host cells that contain any of the foregoing nucleic acid sequences operatively associated with a regulatory element that directs the expression of the coding sequences in the host cell. These recombinant constructs are capable of replicating autonomously in a host cell. Alternatively, the recombinant constructs can become integrated into the chromosomal DNA of a host cell. Such recombinant polynucleotides typically comprise an HCV genomic or cDNA polynucleotide of semi-synthetic or synthetic origin by virtue of human manipulation. Therefore, recombinant nucleic acids comprising these sequences and complements thereof that are not naturally occurring are provided.

Although nucleic acids encoding an HCV peptide or nucleic acids having sequences that complement an HCV gene as they appear in nature can be employed, they will often be altered, e.g., by deletion, substitution, or insertion, and can be accompanied by sequence not present in humans. As used herein, regulatory elements include, but are not limited to, inducible and non-inducible promoters, enhancers, operators and other elements known to those skilled in the art that drive and regulate expression. Such regulatory elements include, but are not limited to, the cytomegalovirus hCMV immediate early gene, the early or late promoters of SV40 adenovirus, the lac system, the trp system, the TAC system, the TRC system, the major operator and promoter regions of phage A, the control regions of fd coat protein, the promoter for 3-phosphoglycerate kinase, the promoters of acid phosphatase, and the promoters of the yeast-mating factors.

In addition, recombinant HCV peptide-encoding nucleic acid sequences and their complementary sequences can be engineered so as to modify their processing or expression. For example, and not by way of limitation, the HCV nucleic acids described herein can be combined with a promoter sequence and/or ribosome binding site, or a signal sequence can be inserted upstream of HCV peptide-encoding sequences so as to permit secretion of the peptide and thereby facilitate harvesting or bioavailability. Additionally, a given HCV nucleic acid can be mutated in vitro or in vivo, to create and/or destroy translation, initiation, and/or termination sequences, or to create variations in coding regions and/or form new restriction sites or destroy preexisting ones, or to facilitate further in vitro modification. (See Example 1). Any technique for mutagenesis known in the art can be used, including but not limited to, in vitro site-directed mutagenesis. (Hutchinson et al., *J. Biol. Chem.*, 253:6551 (1978)). The nucleic acids encoding the HCV peptides, described above, can be manipulated using conventional techniques in molecular biology so as to create recombinant constructs that express the HCV peptides.

Further, nucleic acids encoding other proteins or domains of other proteins can be joined to nucleic acids encoding an HCV peptide so as to create a fusion protein. Nucleotides encoding fusion proteins can include, but are not limited to, a full length NS3/4A sequence (SEQ. ID. NO.: 2 or SEQ. ID. NO.: 36), mutant NS3/4A sequences (e.g., SEQ. ID. NOs.: 3-11 or 40-220) or a peptide fragment of an NS3/4A sequence fused to an unrelated protein or peptide, such as for example, polyhistidine, hemagglutinin, an enzyme, fluorescent protein, or luminescent protein, as discussed below.

It was discovered that the construct "NS3/4A-pVAX" was significantly more immunogenic in vivo than the construct "NS3-pVAX". Surprisingly, it was also discovered that the codon-optimized NS3/4A containing construct ("MSLF1-pVAX") was more immunogenic in vivo than NS3/4A pVAX. The example below describes these experiments.

Example 2

To determine whether a humoral immune response was elicited by the NS3-pVAX and NS3/4A-pVAX vectors, the expression constructs described in Example 1 were purified using the Qiagen DNA purification system, according to the manufacturer's instructions and the purified DNA vectors were used to immunize groups of four to ten Balb/c mice. The plasmids were injected directly into regenerating tibialis anterior (TA) muscles as previously described (Davis et al., *Human Gene Therapy* 4(6):733 (1993)). In brief, mice were injected intramuscularly with 50 µl/TA of 0.01 mM cardiotoxin (Latoxan, Rosans, France) in 0.9% sterile NaCl. Five days later, each TA muscle was injected with 50 µl PBS containing either rNS3 or DNA.

Inbred mouse strains C57/BL6 (H-2b), Balb/C(H-2d), and CBA (H-2k) were obtained from the breeding facility at Möllegard Denmark, Charles River Uppsala, Sweden, or B&K Sollentuna Sweden. All mice were female and were used at 4-8 weeks of age. For monitoring of humoral responses, all mice received a booster injection of 50 µl/TA of plasmid DNA every fourth week. In addition, some mice were given recombinant NS3 (rNS3) protein, which was purified, as described herein. The mice receiving rNS3 were immunized no more than twice. All mice were bled twice a month.

Enzyme immunosorbent assays (EIAs) were used to detect the presence of murine NS3-specific antibodies. These assays were performed essentially as described (Chen et al., *Hepatology* 28 (1): 219 (1998)). Briefly, rNS3 was passively adsorbed overnight at 4° C. to 96-well microtiter plates (Nunc, Copenhagen, Denmark) at 1 µg/ml in 50 mM sodium carbonate buffer (pH 9.6). The plates were then blocked by incubation with dilution buffer containing PBS, 2% goat serum, and 1% bovine serum albumin for one hour at 37° C. Serial dilutions of mouse sera starting at 1:60 were then incubated on the plates for one hour. Bound murine serum antibodies were detected by an alkaline phosphatase conjugated goat anti-mouse IgG (Sigma Cell Products, Saint Louis, Mo.) followed by addition of the substrate pNPP (1 tablet/5 ml of 1M Diethanol amine buffer with 0.5 mM $MgCl_2$). The reaction was stopped by addition of 1M NaOH and absorbency was read at 405 nm.

After four weeks, four out of five mice immunized with NS3/4A-pVAX had developed NS3 antibodies, whereas one out of five immunized with NS3-pVAX had developed antibodies (FIG. 1). After six weeks, four out of five mice immunized with NS3/4A-pVAX had developed high levels ($>10^4$) of NS3 antibodies (mean levels 10800±4830) and one had a titer of 2160. Although all mice immunized with NS3-pVAX developed NS3 antibodies, none of them developed levels as high as that produced by the NS3/4A-pVAX construct (mean levels 1800±805). The antibody levels elicited by the NS3/4A fusion construct were significantly higher than those induced by NS3-pVAX at six weeks (mean ranks 7.6 v.s 3.4, p<0.05, Mann-Whitney rank sum test, and p<0.01, Students t-test). Thus, immunization with either NS3-pVAX or NS3/4A-pVAX resulted in the production of NS3-specific antibodies, but the NS3/4A containing construct was a more potent immunogen.

A similar experiment was conducted to compare the immunogenicity of the NS3/4A-pVAX and MSLF1-pVAX constructs. To better resemble a future vaccination schedule in humans, however, the plasmids were delivered to groups of ten mice using a gene gun. In brief, plasmid DNA was linked to gold particles according to protocols supplied by the manufacturer (Bio-Rad Laboratories, Hercules, Calif.). Prior to immunization, the injection area was shaved and the immunization was performed according to the manufacturer's protocol. Each injection dose contained 4 µg of plasmid DNA. Immunizations were performed on weeks 0, 4, and 8.

The MSLF1 gene was found to be more immunogenic than the native NS3/4A gene since NS3-specific antibodies were significantly higher in mice immunized with the MSLF1-pVAX construct at two weeks after the second and third immunization (TABLE 2). These results confirmed that the codon-optimized MSLF1-pVAX was a more potent B cell immunogen than NS3/4A-pVAX.

TABLE 2

| Immunogen | Week | No. of injections | Mean NS3 titre | SD | Mann-Whitney |
|---|---|---|---|---|---|
| NS3/4A | 2 | 1 | 0 | 0 | NS |
| MSLF1 | 2 | 1 | 0 | 0 | |
| NS3/4A | 6 | 2 | 0 | 0 | p < 0.0002 |
| MSLF1 | 6 | 2 | 2484 | 3800 | |
| NS3/4A | 10 | 3 | 60 | 0 | p < 0.0001 |
| MSLF1 | 10 | 3 | 4140 | 4682 | |

The example below provides more evidence that MSLF-1 (coNS3/4a) produces a strong humoral response.

Example 2A

To test the intrinsic immunogenicity of the different NS3 genes groups of BALB/c ($H-2^d$) mice were immunized with the following vectors: wtNS3/4A (wild type NS3/4a), coNS3/4A (codon-optimized NS3/4a or MSLF-1), or wtNS3/4A-

Figure 10A:
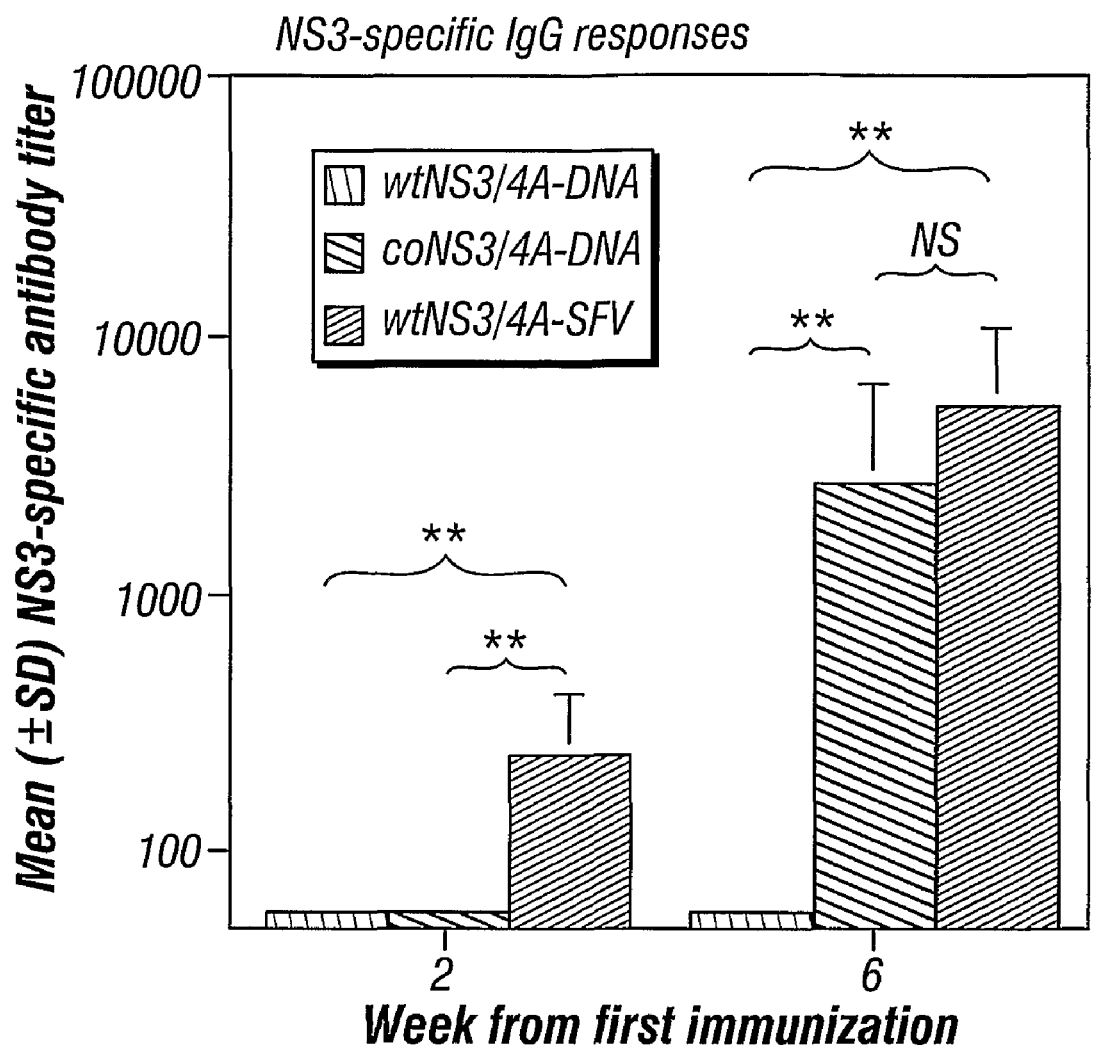
Figure 10B:
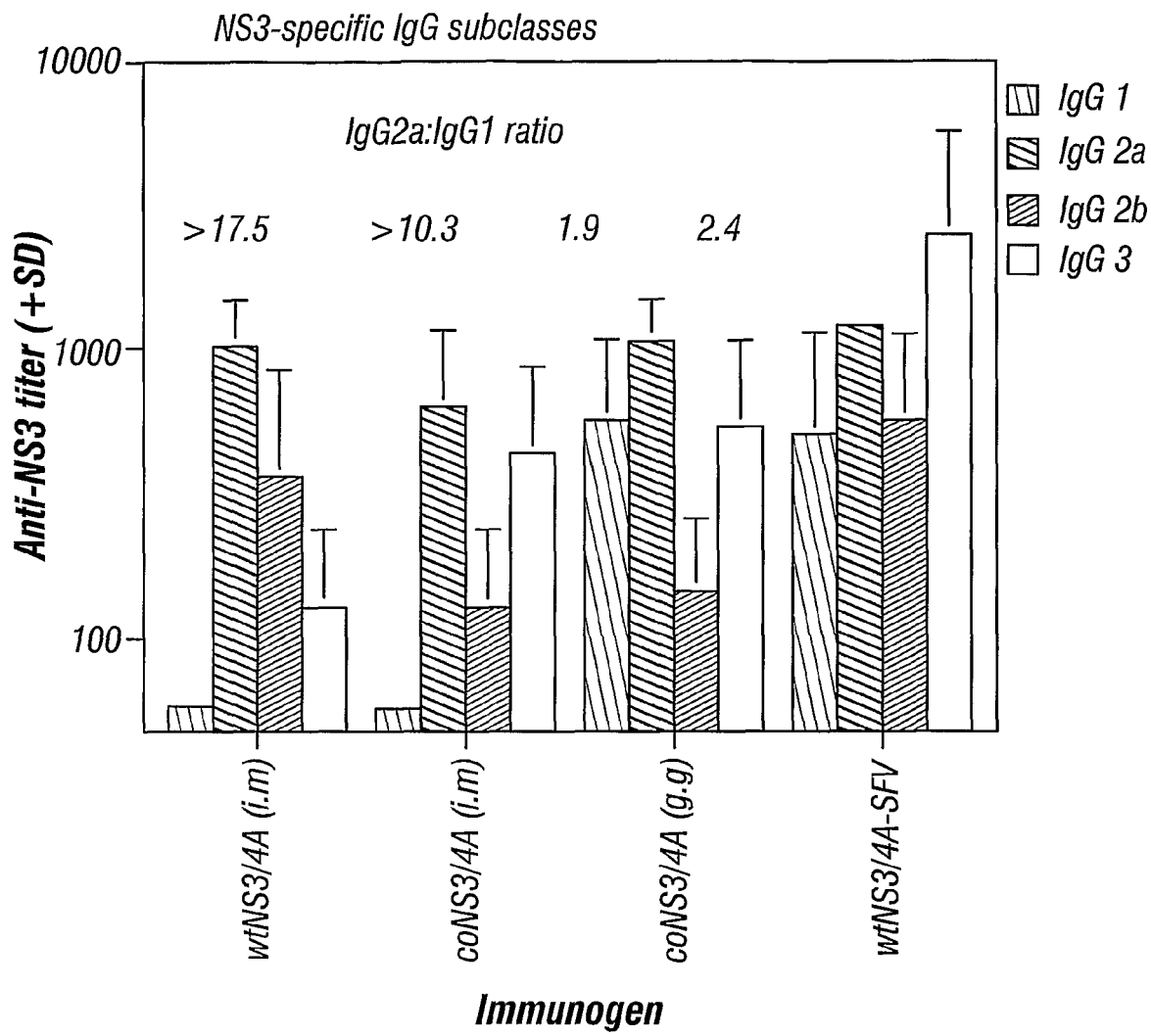

SFV (wild-type NS3/4A obtained from SFV expression). Doses of 4 µg DNA was administered using the gene gun and doses of $10^7$ SFV particles were injected subcutaneously (s.c.). The mice were boosted after four weeks. The mice immunized with the wtNS3/4A-SFV developed antibodies already after the first injection suggesting a potent immunogenicity (FIG. 10). At two weeks after the second immunization most mice immunized with the coNS3/4A or wtNS3/4A-SFV vectors had developed mean antibody levels over $10^3$ (FIG. 10). In contrast, none of the mice immunized with the wtNS3/4A plasmid had developed detectable NS3-specific antibodies at six weeks (FIG. 10). Thus, both codon optimization and mRNA amplification by SFV results in an increased B cell immunogenicity of the NS3/4A gene.

To indirectly compare the T helper 1 (Th1) and Th2-skewing of the T cell response primed by wtNS3/4A, coNS3/4A, and wtNS3/4A-SFV immunizations the levels of NS3-specific IgG1 (Th2) and IgG2a (Th1) antibodies were analyzed (FIG. 10). The IgG2a/IgG1-ratio in mice immunized with rNS3 with or without adjuvant was always <1 regardless of the murine haplotype, signaling a Th2-dominated response. In contrast, mice immunized i.m. with the wtNS3 (wild-type NS3), wtNS3/4A, or coNS3/4A containing plasmids had Th1-skewed Th-cell responses evidenced by IgG2a/IgG1 ratios of >1 (FIG. 10). Thus, codon optimization did not change the IgG subclass distribution. When genetically immunizing BALB/c mice with NS3/4A using the gene gun the subclass ratio suggested a mixed Th1/Th2 response (FIG. 10). It should be noted that the codon optimized plasmid did not display an increased in vitro stimulatory capacity of B cells, as compared to the native plasmid, suggesting that no major immune stimulatory motifs had been lost or introduced.

Immunizations using SFV primed a Th1-, or mixed Th1/Th2-like isotype distribution. The anti-NS3 IgG2a/IgG1-ratio following wtNS3/4A-SFV immunization ranged from 2.4 to 20 between different experiments providing evidence of a Th1-like response. This is similar to the previous experience with SFV vectors where a Th1-skewed IgG subclass distribution was observed.

The example below describes experiments that were performed to determine if mutant NS3/4A peptides, which lack a proteolytic cleavage site, could elicit an immune response to NS3.

Example 3

To test if the enhanced immunogenicity of NS3/4A could be solely attributed to the presence of NS4A, or if the NS3/4A fusion protein in addition had to be cleaved at the NS3/4A junction, another set of experiments were performed. In a first experiment, the immunogenicity of the NS3-pVAX, NS3/4A-pVAX, and mutant NS3/4A constructs were compared in Balb/c mice. Mice were immunized on week 0 as described above, and, after two weeks, all mice were bled and the presence of antibodies to NS3 at a serum dilution of 1:60 was determined (TABLE 3). Mice were bled again on week 4. As shown in TABLE 3, all the constructs induced an immune response; the mutant constructs, for example, the NS3/4A-TGT-pVAX vector was comparable to the NS3-pVAX vector (4/10 vs. 0/10; NS, Fisher's exact test). The NS3/4A-pVAX vector, however, was more potent than the mutant constructs.

TABLE 3

| | No. of antibody responders to the respective immunogen after one 100 µg i.m immunization | | |
|---|---|---|---|
| Weeks from 1$^{st}$ immunization | NS3-pVAX | wild-type NS3/4A-pVAX | mutant example NS3/4A-TGT-pVAX |
| 2 | 0/10 | 17/20 | 4/10 |
| 4 | | 20/20 | 10/10 |
| | 0/10 | (2415 ± 3715) | (390 ± 639) |
| | (<60) | 55% > $10^3$ | 50% > $10^2$ |
| | | 10% > $10^4$ | 10% > $10^3$ |

During the chronic phase of infection, HCV replicates in hepatocytes, and spreads within the liver. A major factor in combating chronic and persistent viral infections is the cell-mediated immune defense system. CD4+ and CD8+ lymphocytes infiltrate the liver during the chronic phase of HCV infection, but they are incapable of clearing the virus or preventing liver damage. In addition, persistent HCV infection is associated with the onset of hepatocellular carcinoma (HCC). The examples below describe experiments that were performed to determine whether the NS3, NS3/4A, and MSLF1 constructs were capable of eliciting a T-cell mediated immune response against NS3.

Example 4

To study whether the constructs described above were capable of eliciting a cell-mediated response against NS3, an in vivo tumor growth assay was performed. To this end, an SP2/0 tumor cell line (SP2/0-Ag14 myeloma cell line (H-2$^d$)) stably transfected with the NS3/4A gene was made. The SP2/0 cells were maintained in DMEM medium supplemented with 10% fetal calf serum (FCS; Sigma Chemicals, St. Louis, Mo.), 2 mM L-Glutamine, 10 mM HEPES, 100 U/ml Penicillin and 100 µg/ml Streptomycin, 1 mM non-essential amino acids, 50 µM β-mercaptoethanol, 1 mM sodium pyruvate (GIBCO-BRL, Gaithesburgh, Md.). The pcDNA3.1 plasmid containing the NS3/4A gene was linearized by BglII digestion. A total of 5 µg linearized plasmid DNA was mixed with 60 µg transfection reagent (Superfect, Qiagen, Germany) and the mixture was added to a 50% confluent layer of SP2/0 cells in a 35 mm dish. The transfection procedure was performed according to manufacturer's protocol.

Transfected cells were cloned by limiting dilution and selected by addition of 800 µg geneticin (G418)/ml complete DMEM medium after 14 days. A stable NS3/4A-expressing SP2/0 clone was identified using PCR and RTPCR and/or a capture EIA using a monoclonal antibody to NS3. All EIAs for the detection of murine NS3 antibodies were essentially performed as follows. In brief, rNS3 (recombinant NS3 protein produced in *E. Coli*, dialyzed overnight against PBS, and sterile filtered) was passively adsorbed overnight at 4° C. to 96-well microtiter plates (Nunc, Copenhagen, Denmark) at 1 µg/ml in 50 mM sodium carbonate buffer (pH 9.6). The plates were then blocked by incubation with dilution buffer containing PBS, 2% goat serum, and 1% bovine serum albumin for one hour at +37° C. Serial dilutions of mouse sera starting at 1:60 were then incubated on the plates for one hour. Bound murine serum antibodies were detected by an alkaline phosphatase conjugated goat anti-mouse IgG (Sigma cellproducts, Saint Louis, Mo. USA) followed by addition of the substrate pNPP (1 tablet/5 ml of 1M Diethanolamine buffer with 0.5 mM MgCl2). The reaction was stopped by addition of 1M NaOH. Absorbance was then read at 405 nm.

The in vivo growth kinetics of the SP2/0 and the NS3/4A-SP2/0 cell lines were then evaluated in Balb/c mice. Mice were injected subcutaneously with $2 \times 10^6$ tumor cells in the right flank. Each day the size of the tumor was determined through the skin. The growth kinetics of the two cell lines was comparable. The mean tumor sizes did not differ between the two cell lines at any time point, for example. (See TABLE 4).

TABLE 4

| Mouse ID | Tumor cell line | Maximum in vivo tumor size at indicated time point | | | | | | | | |
|---|---|---|---|---|---|---|---|---|---|---|
| | | 5 | 6 | 7 | 8 | 11 | 12 | 13 | 14 | 15 |
| 1 | SP2/0 | 1.6 | 2.5 | 4.5 | 6.0 | 10.0 | 10.5 | 11.0 | 12.0 | 12.0 |
| 2 | SP2/0 | 1.0 | 1.0 | 2.0 | 3.0 | 7.5 | 7.5 | 8.0 | 11.5 | 11.5 |
| 3 | SP2/0 | 2.0 | 5.0 | 7.5 | 8.0 | 11.0 | 11.5 | 12.0 | 12.0 | 13.0 |
| 4 | SP2/0 | 4.0 | 7.0 | 8.0 | 10.0 | 13.0 | 15.0 | 16.5 | 16.5 | 17.0 |
| 5 | SP2/0 | 1.0 | 1.0 | 3.0 | 4.0 | 5.0 | 6.0 | 6.0 | 6.0 | 7.0 |
| | Group mean | 1.92 | 3.3 | 5.0 | 6.2 | 9.3 | 10.1 | 10.7 | 11.6 | 12.1 |
| 6 | NS3/4A-SP2/0 | 1.0 | 2.0 | 3.0 | 3.5 | 4.0 | 5.5 | 6.0 | 7.0 | 8.0 |
| 7 | NS3/4A-SP2/0 | 2.0 | 2.5 | 3.0 | 5.0 | 7.0 | 9.0 | 9.5 | 9.5 | 11.0 |
| 8 | NS3/4A-SP2/0 | 1.0 | 2.0 | 3.5 | 3.5 | 9.5 | 11.0 | 12.0 | 14.0 | 14.0 |
| 9 | NS3/4A-SP2/0 | 1.0 | 1.0 | 2.0 | 6.0 | 11.5 | 13.0 | 14.5 | 16.0 | 18.0 |
| 10 | NS3/4A-SP2/0 | 3.5 | 6.0 | 7.0 | 10.5 | 15.0 | 15.0 | 15.0 | 15.5 | 20.0 |
| | Group mean | 1.7 | 2.7 | 3.7 | 5.7 | 9.4 | 10.7 | 11.4 | 12.4 | 14.2 |
| | p-value of student's t-test comparison between group means | 0.7736 | 0.6918 | 0.4027 | 0.7903 | 0.9670 | 0.7986 | 0.7927 | 0.7508 | 0.4623 |

The example below describes experiments that were performed to determine whether mice immunized with the NS3/4A constructs had developed a T-cell response against NS3.

Example 5

To examine whether a T-cell response was elicited by the NS3/4A immunization, the capacity of an immunized mouse's immune defense system to attack the NS3-expressing tumor cell line was assayed. The protocol for testing for in vivo inhibition of tumor growth of the SP2/0 myeloma cell line in Balb/c mice has been described in detail previously (Encke et al., *J. Immunol.* 161:4917 (1998)). Inhibition of tumor growth in this model is dependent on the priming of cytotoxic T lymphocytes (CTLs). In a first set of experiments, groups of ten mice were immunized i.m. five times with one month intervals with either 100 μg NS3-pVAX or 100 μg NS3/4A-pVAX. Two weeks after the last immunization $2 \times 10^6$ SP2/0 or NS3/4A-SP2/0 cells were injected into the right flank of each mouse. Two weeks later the mice were sacrificed and the maximum tumor sizes were measured. There was no difference between the mean SP2/0 and NS3/4A-SP2/0 tumor sizes in the NS3-pVAX immunized mice. (See TABLE 5).

TABLE 5

| Mouse ID | Immunogen | Dose (μg) | Tumor cell line | Tumor growth | Maximum tumor size (mm) |
|---|---|---|---|---|---|
| 1 | NS3-pVAX | 100 | SP2/0 | Yes | 5 |
| 2 | NS3-pVAX | 100 | SP2/0 | Yes | 15 |
| 3 | NS3-pVAX | 100 | SP2/0 | No | — |
| 4 | NS3-pVAX | 100 | SP2/0 | Yes | 6 |
| 5 | NS3-pVAX | 100 | SP2/0 | Yes | 13 |
| | Group total | | | 4/5 | 9.75 ± 4.992 |

TABLE 5-continued

| 6 | NS3-pVAX | 100 | NS3/4A-SP2/0 | Yes | 9 |
|---|---|---|---|---|---|
| 7 | NS3-pVAX | 100 | NS3/4A-SP2/0 | Yes | 8 |
| 8 | NS3-pVAX | 100 | NS3/4A-SP2/0 | Yes | 7 |
| 9 | NS3-pVAX | 100 | NS3/4A-SP2/0 | No | — |
| 10 | NS3-pVAX | 100 | NS3/4A-SP2/0 | No | — |
| | | | | 3/5 | 8.00 ± 1.00 |

TABLE 5-continued

Unpaired t-test for Max diam

Grouping Variable: Column 1

Hypothesized Difference = 0

Row exclusion: NS3DNA-Tumor-001213

| | Mean Diff. | DF | t-Value | P-Value |
|---|---|---|---|---|
| NS3-sp2, NS3-spNS3 | 1.750 | 5 | 0.58 | 0.584 |

Group Info for Max diam

Grouping Variable: Column 1

Row exclusion: NS3DNA-Tumor-001213

| | Count | Mean | Variance | Std. Dev. | Std. Err |
|---|---|---|---|---|---|
| NS3-sp2 | 4 | 9.750 | 24.917 | 4.992 | 2.496 |
| NS3-spNS3 | 3 | 8.000 | 1.000 | 1.000 | 0.57 |

Note:
Statistical analysis (StatView): Student's t-test on maximum tumor size. P-values < 0.05 are considered significant.

To analyze whether administration of different NS3 containing compositions affected the elicitation of a cell-mediated immune response, mice were immunized with PBS, rNS3, a control DNA, or the NS3/4A construct, and tumor sizes were determined, as described above. The NS3/4A construct was able to elicit a T-cell response sufficient to cause a statistically significant reduction in tumor size (See TABLE 6).

TABLE 6

| Mouse ID | Immunogen | Dose (μg) | Tumor cell line | Anti-NS3 | Tumor growth | Maximum tumor size (mm) |
|---|---|---|---|---|---|---|
| 1 | NS3-pVAX | 10 | NS3/4A-SP2/0 | <60 | + | 12.0 |
| 2 | NS3-pVAX | 10 | NS3/4A-SP2/0 | <60 | + | 20.0 |
| 3 | NS3-pVAX | 10 | NS3/4A-SP2/0 | 60 | + | 18.0 |
| 4 | NS3-pVAX | 10 | NS3/4A-SP2/0 | <60 | + | 13.0 |
| 5 | NS3-pVAX | 10 | NS3/4A-SP2/0 | <60 | + | 17.0 |
| | Group mean | | | 60 | 5/5 | 16.0 ± 3.391 |
| 6 | NS3-pVAX | 100 | NS3/4A-SP2/0 | 2160 | + | 10.0 |
| 7 | NS3-pVAX | 100 | NS3/4A-SP2/0 | <60 | − | — |
| 8 | NS3-pVAX | 100 | NS3/4A-SP2/0 | <60 | − | — |
| 9 | NS3-pVAX | 100 | NS3/4A-SP2/0 | 360 | − | — |
| 10 | NS3-pVAX | 100 | NS3/4A-SP2/0 | <60 | + | 12.5 |
| | Group mean | | | 1260 | 2/5 | 11.25 ± 1.768 |
| 11 | NS3/4A-pVAX | 10 | NS3/4A-SP2/0 | <60 | + | 10.0 |
| 12 | NS3/4A-pVAX | 10 | NS3/4A-SP2/0 | <60 | − | — |
| 13 | NS3/4A-pVAX | 10 | NS3/4A-SP2/0 | <60 | − | — |
| 14 | NS3/4A-pVAX | 10 | NS3/4A-SP2/0 | <60 | + | 13.0 |
| 15 | NS3/4A-pVAX | 10 | NS3/4A-SP2/0 | <60 | + | 13.5 |
| | Group mean | | | <60 | 3/5 | 12.167 ± 1.893 |
| 16 | NS3/4A-pVAX | 100 | NS3/4A-SP2/0 | 60 | + | 10.0 |
| 17 | NS3/4A-pVAX | 100 | NS3/4A-SP2/0 | 360 | − | — |
| 18 | NS3/4A-pVAX | 100 | NS3/4A-SP2/0 | 2160 | + | 8.0 |
| 19 | NS3/4A-pVAX | 100 | NS3/4A-SP2/0 | 2160 | + | 12.0 |
| 20 | NS3/4A-pVAX | 100 | NS3/4A-SP2/0 | 2160 | + | 7.0 |
| | Group mean | | | 1380 | 4/5 | 9.25 ± 2.217 |
| 36 | p17-pcDNA3 | 100 | NS3/4A-SP2/0 | <60 | + | 20.0 |
| 37 | p17-pcDNA3 | 100 | NS3/4A-SP2/0 | <60 | + | 7.0 |
| 38 | p17-pcDNA3 | 100 | NS3/4A-SP2/0 | <60 | + | 11.0 |
| 39 | p17-pcDNA3 | 100 | NS3/4A-SP2/0 | <60 | + | 15.0 |
| 40 | p17-pcDNA3 | 100 | NS3/4A-SP2/0 | <60 | + | 18.0 |
| | Group mean | | | <60 | 5/5 | 14.20 ± 5.263 |
| 41 | rNS3/CFA | 20 | NS3/4A-SP2/0 | >466560 | + | 13.0 |
| 42 | rNS3/CFA | 20 | NS3/4A-SP2/0 | >466560 | − | — |
| 43 | rNS3/CFA | 20 | NS3/4A-SP2/0 | >466560 | + | 3.5 |
| 44 | rNS3/CFA | 20 | NS3/4A-SP2/0 | >466560 | + | 22.0 |
| 45 | rNS3/CFA | 20 | NS3/4A-SP2/0 | >466560 | + | 17.0 |
| | Group mean | | | 466560 | 4/5 | 17.333 ± 4.509 |
| 46 | PBS | — | NS3/4A-SP2/0 | <60 | + | 10.0 |
| 47 | PBS | — | NS3/4A-SP2/0 | <60 | + | 16.5 |
| 48 | PBS | — | NS3/4A-SP2/0 | 60 | + | 15.0 |
| 49 | PBS | — | NS3/4A-SP2/0 | <60 | + | 21.0 |
| 50 | PBS | — | NS3/4A-SP2/0 | <60 | + | 15.0 |
| 51 | PBS | — | NS3/4A-SP2/0 | <60 | − | — |
| | Group mean | | | 60 | 5/6 | 15.50 ± 3.937 |

Unpaired t-test for Largest Tumor size
Grouping Variable: group
Hypothesized Difference = 0

| | Mean Diff. | DF | t-Value | P-Value |
|---|---|---|---|---|
| p17-sp3-4, NS3-100-sp3-4 | 2.950 | 5 | .739 | .4933 |
| p17-sp3-4, NS3/4-10-sp3-4 | 2.033 | 6 | .628 | .5532 |
| p17-sp3-4, NS3-10-sp3-4 | −1.800 | 8 | −.643 | .5383 |
| p17-sp3-4, NS3/4-100-sp3-4 | 4.950 | 7 | 1.742 | .1250 |
| p17-sp3-4, PBS-sp3-4 | −1.300 | 8 | −.442 | .6700 |
| p17-sp3-4, rNS3-sp3-4 | −3.133 | 6 | −.854 | .4259 |
| NS3-100-sp3-4, NS3/4-10-sp3-4 | −.917 | 3 | −.542 | .6254 |
| NS3-100-sp3-4, NS3-10-sp3-4 | −4.750 | 5 | −1.811 | .1299 |
| NS3-100-sp3-4, NS3/4-100-sp3-4 | 2.000 | 4 | 1.092 | .3360 |
| NS3-100-sp3-4, PBS-sp3-4 | −4.250 | 5 | −1.408 | .2183 |
| NS3-100-sp3-4, rNS3-sp3-4 | −6.083 | 3 | −1.744 | .1795 |
| NS3/4-10-sp3-4, NS3-10-sp3-4 | −3.833 | 6 | −1.763 | .1283 |
| NS3/4-10-sp3-4, NS3/4-100-sp3-4 | 2.917 | 5 | 1.824 | .1277 |
| NS3/4-10-sp3-4, PBS-sp3-4 | −3.333 | 6 | −1.344 | .2274 |
| NS3/4-10-sp3-4, rNS3-sp3-4 | −5.167 | 4 | −1.830 | .1412 |
| NS3-10-sp3-4, NS3/4-100-sp3-4 | 6.750 | 7 | 3.416 | .0112 |
| NS3-10-sp3-4, PBS-sp3-4 | .500 | 8 | .215 | .8350 |
| NS3-10-sp3-4, rNS3-sp3-4 | −1.333 | 6 | −.480 | .6480 |
| NS3/4-100-sp3-4, PBS-sp3-4 | −6.250 | 7 | −2.814 | .0260 |
| NS3/4-100-sp3-4, rNS3-sp3-4 | −8.083 | 5 | −3.179 | .0246 |
| PBS-sp3-4, rNS3-sp3-4 | −1.833 | 6 | −.607 | .5662 |

Note:
Statistical analysis (StatView): Student's t-test on maximum tumor size. P-values < 0.05 are considered as significant.

The example below describes more experiments that were performed to determine whether the reduction in tumor size can be attributed to the generation of NS3-specific T-lymphocytes.

Example 6

In the next set of experiments, the inhibition of SP2/0 or NS3/4A-SP2/0 tumor growth was again evaluated in NS3/4A-pVAX immunized Balb/c mice. In mice immunized with the NS3/4A-pVAX plasmid, the growth of NS3/4A-SP2/0 tumor cells was significantly inhibited as compared to growth of the non-transfected SP2/0 cells. (See TABLE 7). Thus, NS3/4A-pVAX immunization elicits CTLs that inhibit growth of cells expressing NS3/4A in vivo.

sizes were calculated and groups were compared using the Mann-Whitney non-parametric test. At day 14 all mice were sacrificed.

Figure 2:
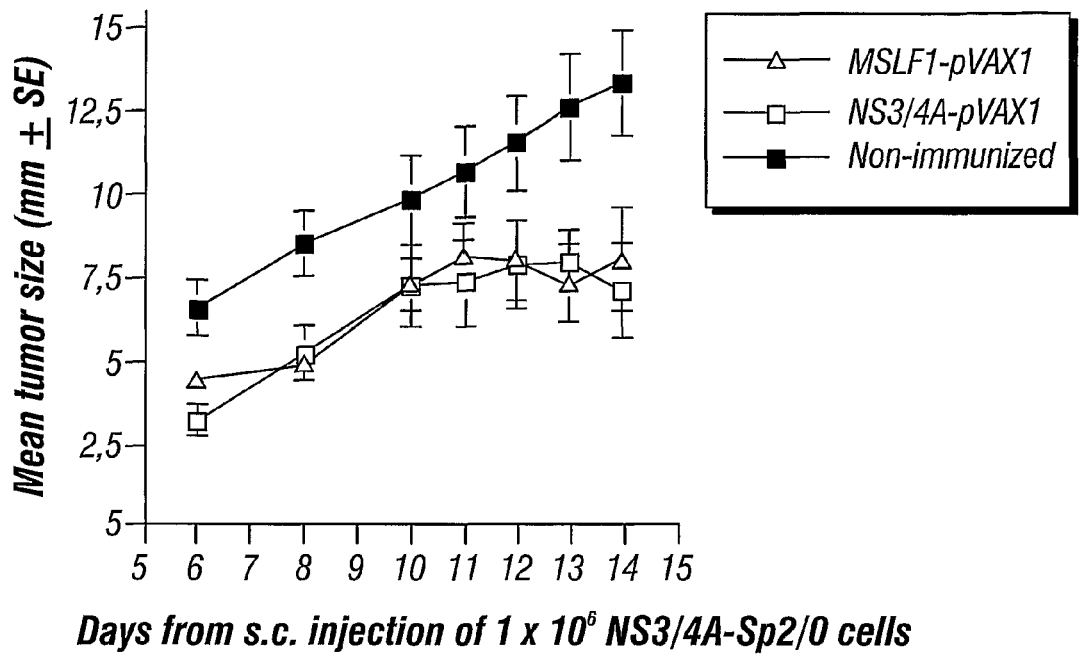
Figure 3:
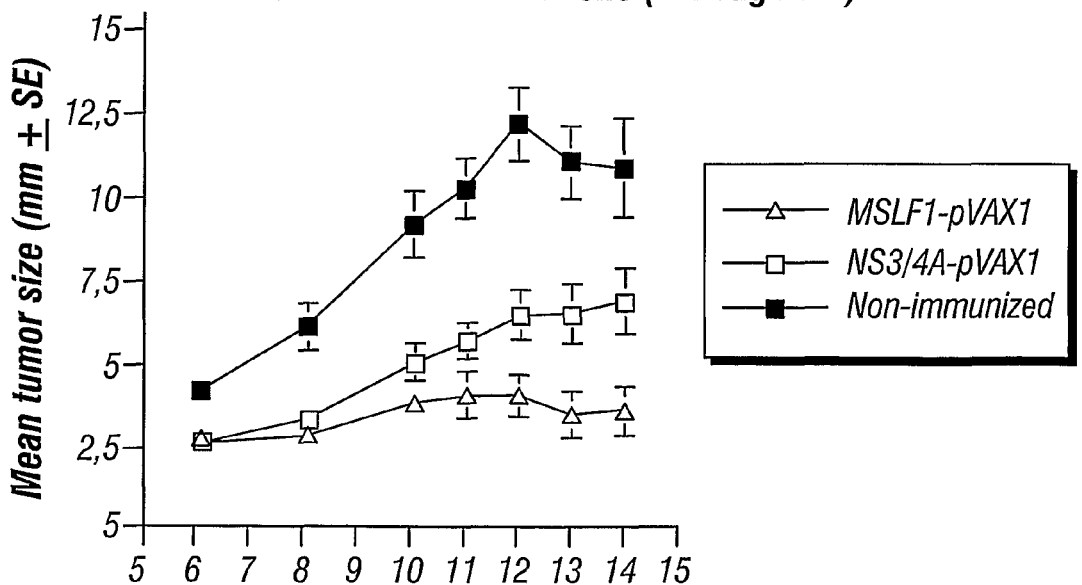
Figure 4:
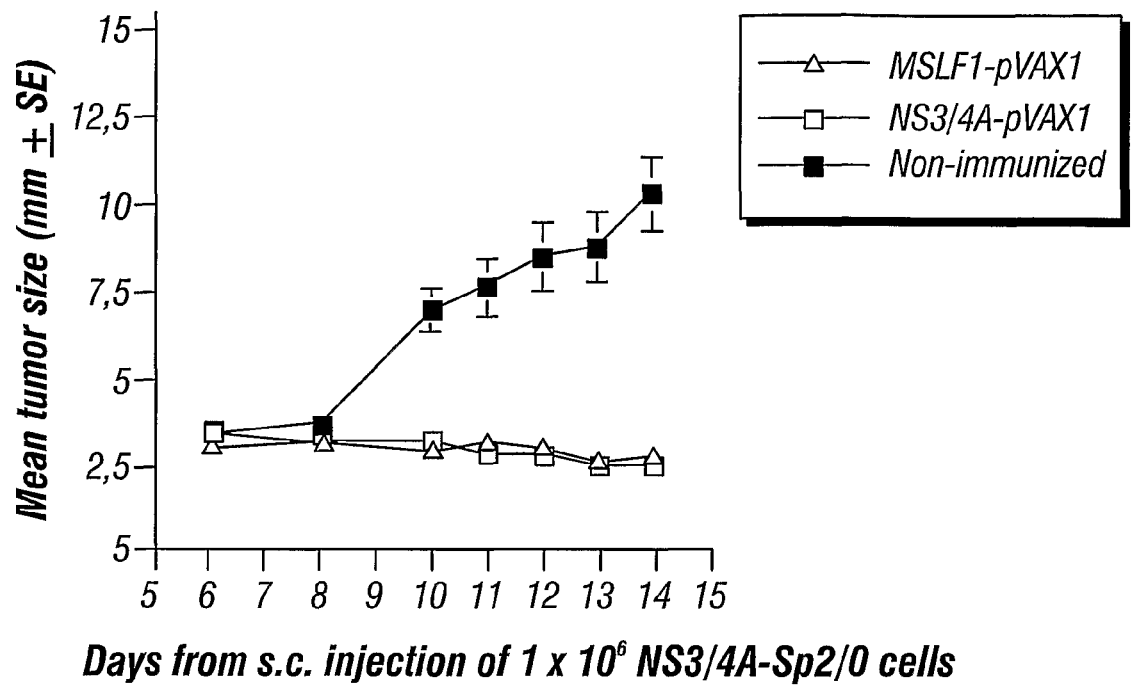

After only a single immunization, tumor inhibiting responses were observed. (See FIG. 2 and TABLE 8). After two immunizations, both the NS3/4A-pVAX and MSLF1-pVAX plasmids primed tumor-inhibiting responses. (See FIG. 3 and TABLE 9). The tumors were significantly smaller in mice immunized with the MSLF1 gene, however, as compared to the native NS3/4A gene. After three injections, both plasmids effectively primed comparable tumor inhibiting responses. (See FIG. 4 and TABLE 10). These experiments provided evidence that the MSLF-1 gene was more efficient in activating tumor inhibiting immune responses in vivo than NS3/4A-pVAX.

TABLE 7

| Mouse ID | Immunogen | Dose (µg) | Tumor cell line | Tumor growth | Maximum tumor size (mm) |
|---|---|---|---|---|---|
| 11 | NS3/4A-pVAX | 100 | SP2/0 | No | — |
| 12 | NS3/4A-pVAX | 100 | SP2/0 | Yes | 24 |
| 13 | NS3/4A-pVAX | 100 | SP2/0 | Yes | 9 |
| 14 | NS3/4A-pVAX | 100 | SP2/0 | Yes | 11 |
| 15 | NS3/4A-pVAX | 100 | SP2/0 | Yes | 25 |
| | | | | 4/5 | 17.25 ± 8.421 |
| 16 | NS3/4A-pVAX | 100 | NS3/4A-SP2/0 | No | — |
| 17 | NS3/4A-pVAX | 100 | NS3/4A-SP2/0 | Yes | 9 |
| 18 | NS3/4A-pVAX | 100 | NS3/4A-SP2/0 | Yes | 7 |
| 19 | NS3/4A-pVAX | 100 | NS3/4A-SP2/0 | Yes | 5 |
| 20 | NS3/4A-pVAX | 100 | NS3/4A-SP2/0 | Yes | 4 |
| | | | | 4/5 | 6.25 ± 2.217 |

Unpaired t-test for Max diam
Grouping Variable: Column 1
Hypothesized Difference = 0
Row exclusion: NS3DNA-Tumor-001213

| | Mean Diff. | DF | t-Value | P-Value |
|---|---|---|---|---|
| NS3/4-sp2, NS3/4-spNS3 | 11.000 | 6 | 2.526 | 0.044 |

Group Info for Max diam
Grouping Variable: Column 1
Row exclusion: NS3DNA-Tumor-001213

| | Count | Mean | Variance | Std. Dev. | Std. Err |
|---|---|---|---|---|---|
| NS3/4-sp2 | 4 | 17.250 | 70.917 | 8.421 | 4.211 |
| NS3/4-spNS3 | 4 | 6.250 | 4.917 | 2.217 | 1.109 |

Note:
Statistical analysis (StatView): Student's t-test on maximum tumor size. P-values < 0.05 are considered significant.

In another set of experiments, the inhibition of NS3/4A-expressing SP2/0 tumor growth was evaluated in MSLF1-pVAX immunized Balb/c mice. In brief, groups of mice were immunized with different immunogens (4 µg of plasmid) using a gene gun at weeks zero, four, eight, twelve, and sixteen. Two weeks after the last immunization approximately $2 \times 10^6$ NS3/4A-expressing SP2/0 cells were injected s.c into the right flank of the mouse. The kinetics of the tumor growth was then monitored by measuring the tumor size through the skin at days seven, 11, and 13. The mean tumor

TABLE 8

| Group | MSLF1-pVAX1 | NS3/4A-pVAX1 | Non-immunized |
|---|---|---|---|
| MSLF1-pVAX1 | — | N.S. | p < 0.05 |
| NS3/4A-pVAX1 | N.S. | — | p < 0.05 |
| Non-immunized | p < 0.05 | p < 0.05 | — |

TABLE 9

| Group | MSLF1-pVAX1 | NS3/4A-pVAX1 | Non-immunized |
|---|---|---|---|
| MSLF1-pVAX1 | — | p < 0.05 | p < 0.01 |
| NS3/4A-pVAX1 | p < 0.05 | — | p < 0.01 |
| Non-immunized | p < 0.01 | p < 0.01 | — |

TABLE 10

| Group | MSLF1-pVAX1 | NS3/4A-pVAX1 | Non-immunized |
|---|---|---|---|
| MSLF1-pVAX1 | — | N.S. | p < 0.01 |
| NS3/4A-pVAX1 | N.S. | — | p < 0.01 |
| Non-immunized | p < 0.01 | p < 0.01 | — |

The example below describes experiments that were performed to analyze the efficiency of various NS3 containing compositions in eliciting a cell-mediated response to NS3.

Example 7

Figure 5A:
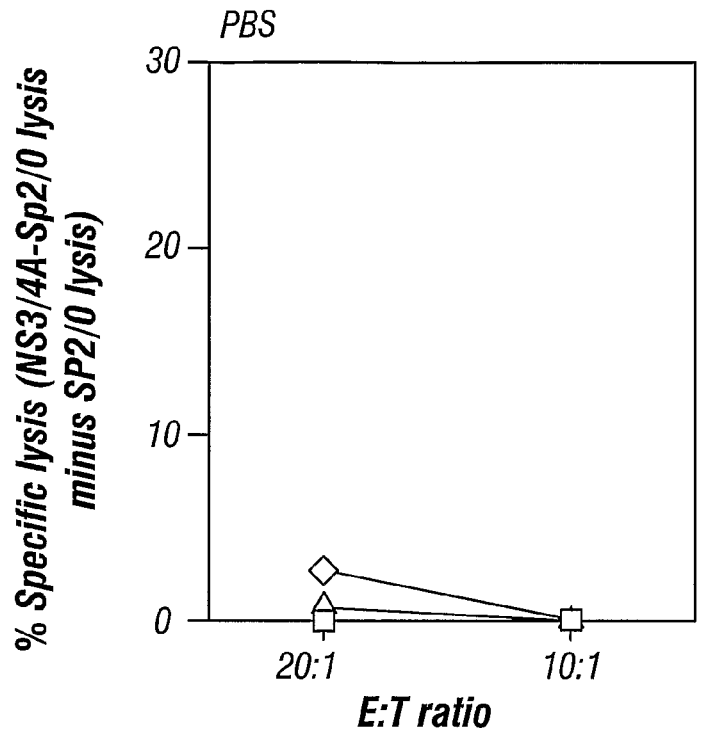
Figure 5B:
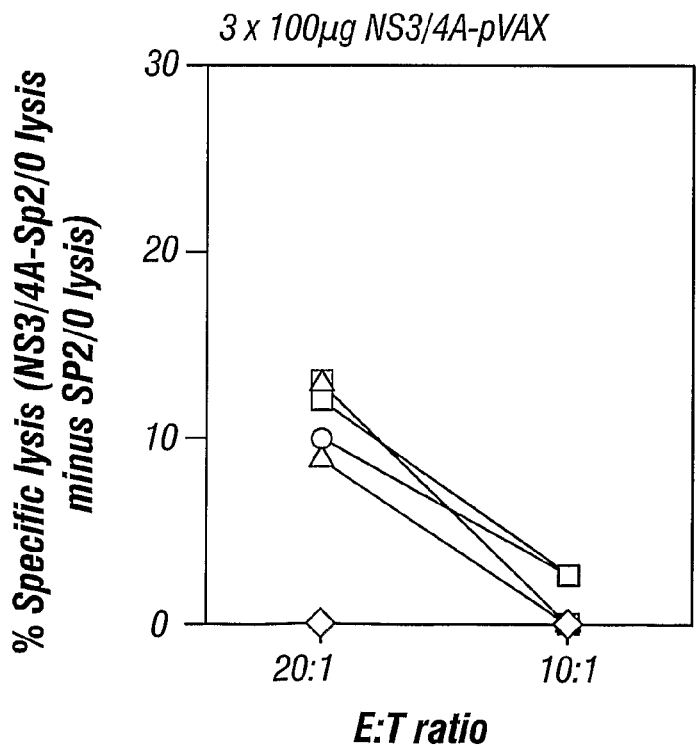
Figure 6A:
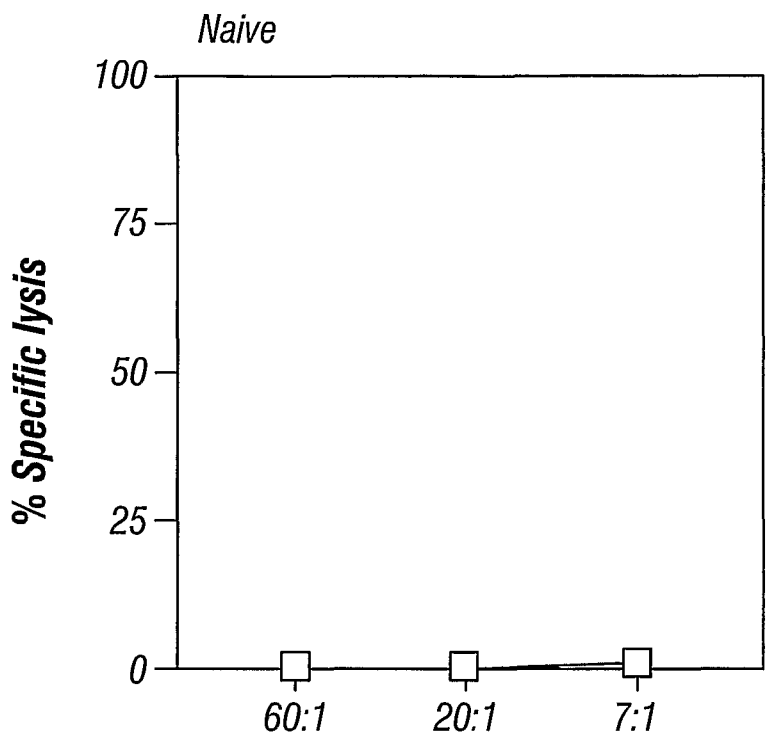
Figure 6B:
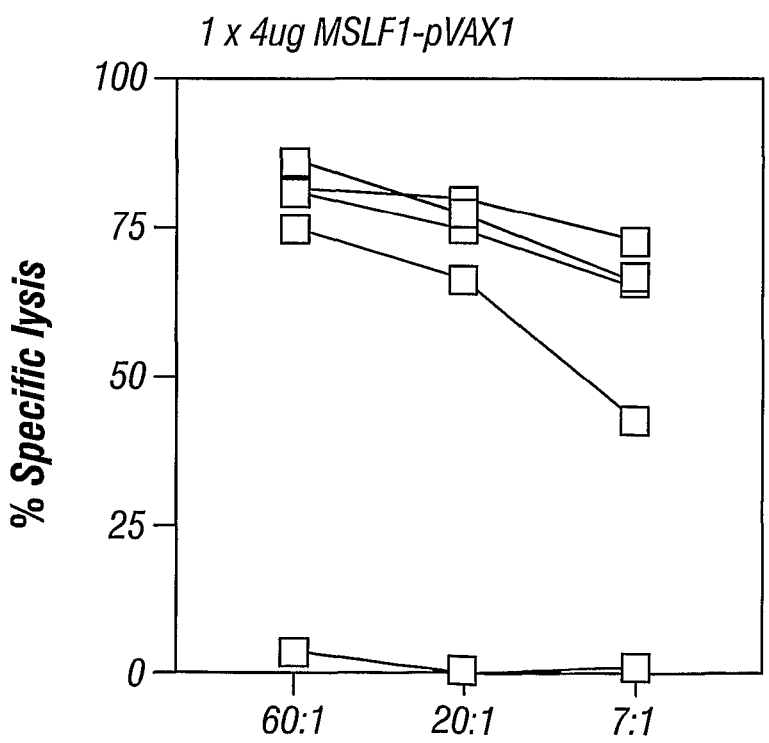
Figure 6C:
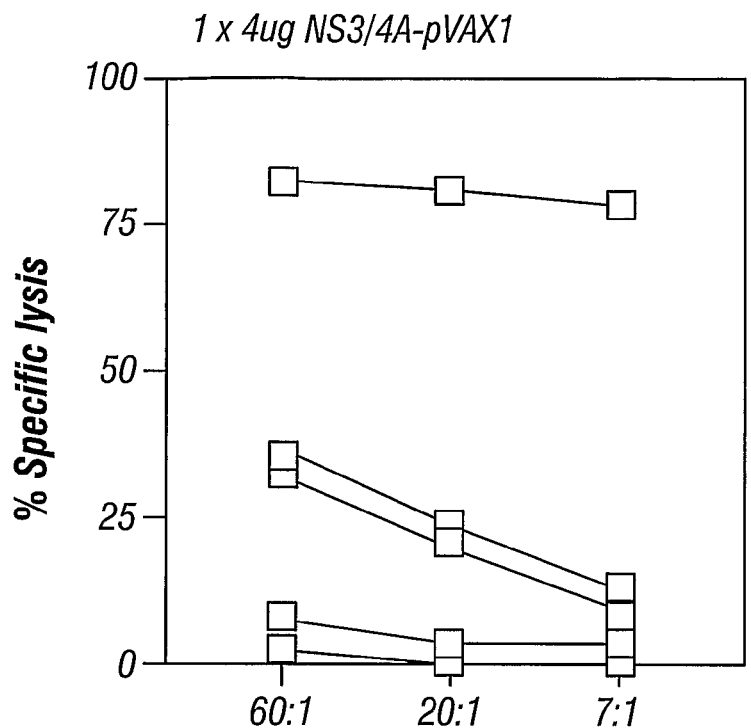
Figure 6D:
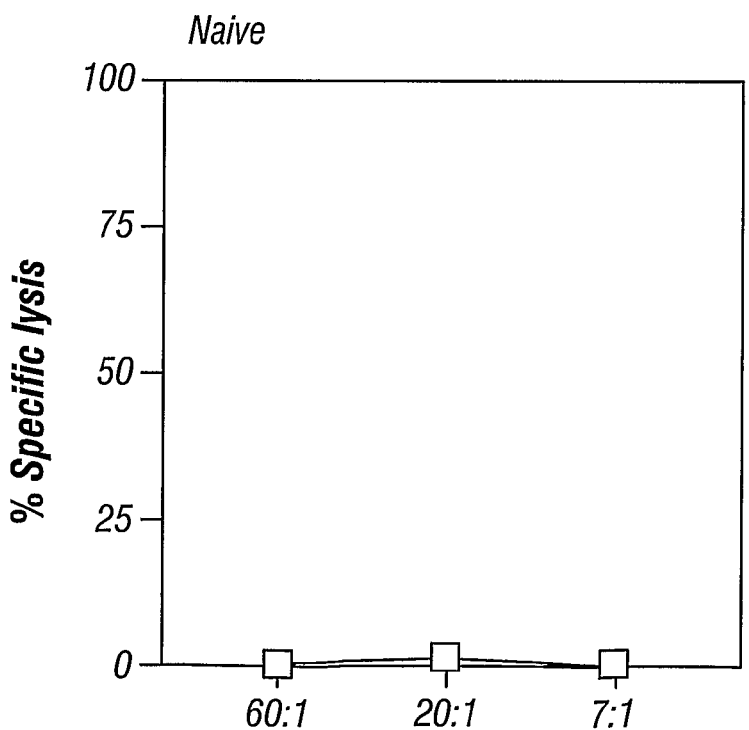
Figure 6E:
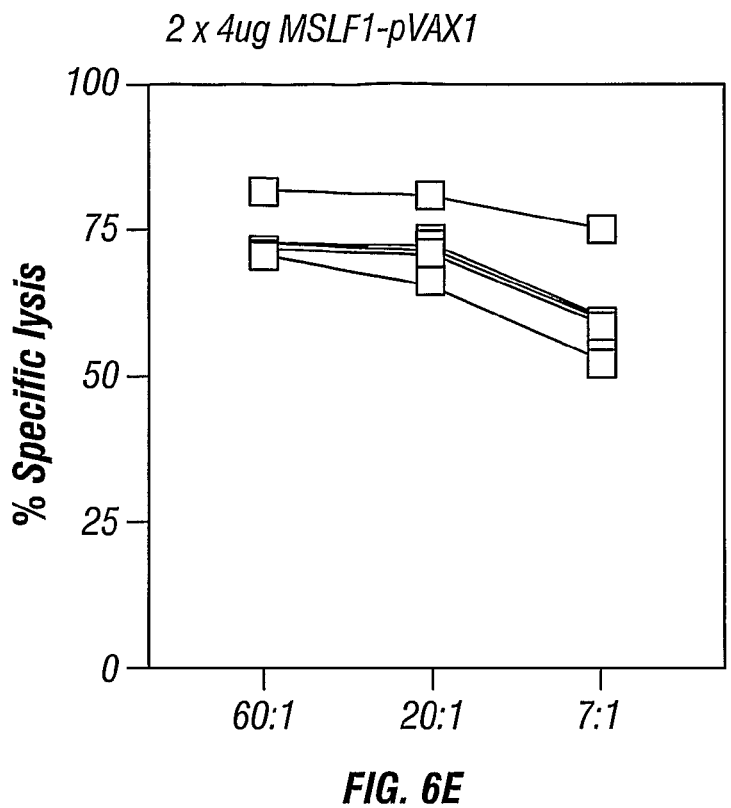
Figure 6F:
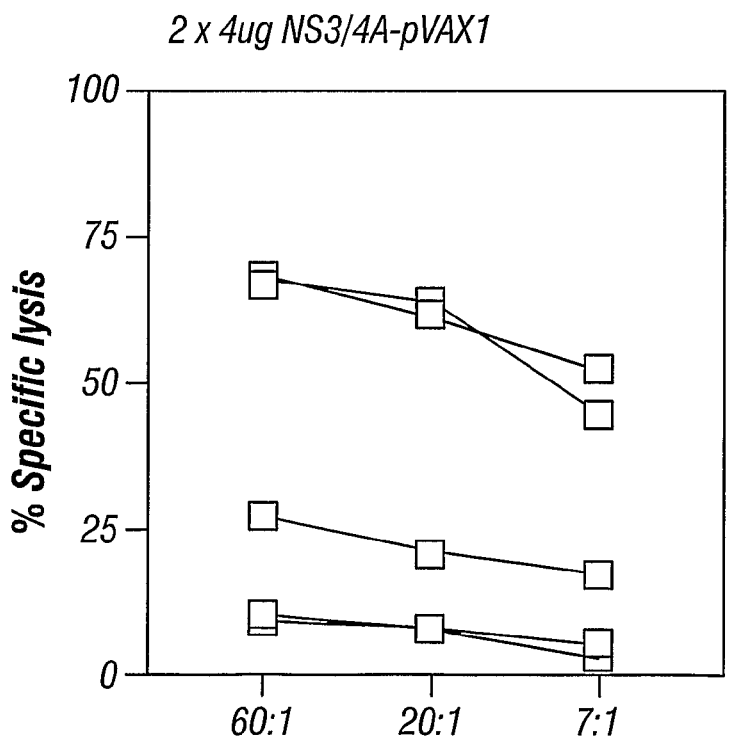
Figure 6G:
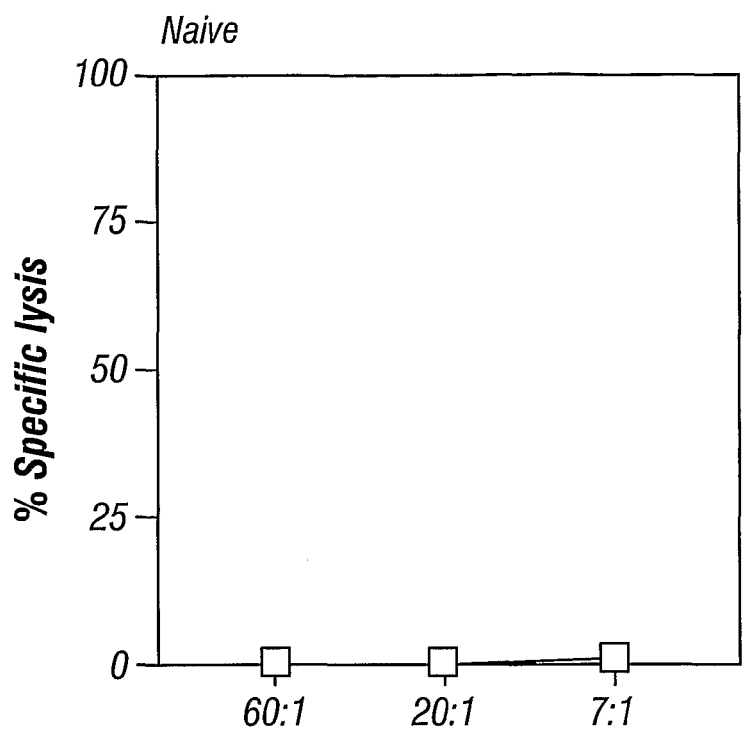
Figure 6H:
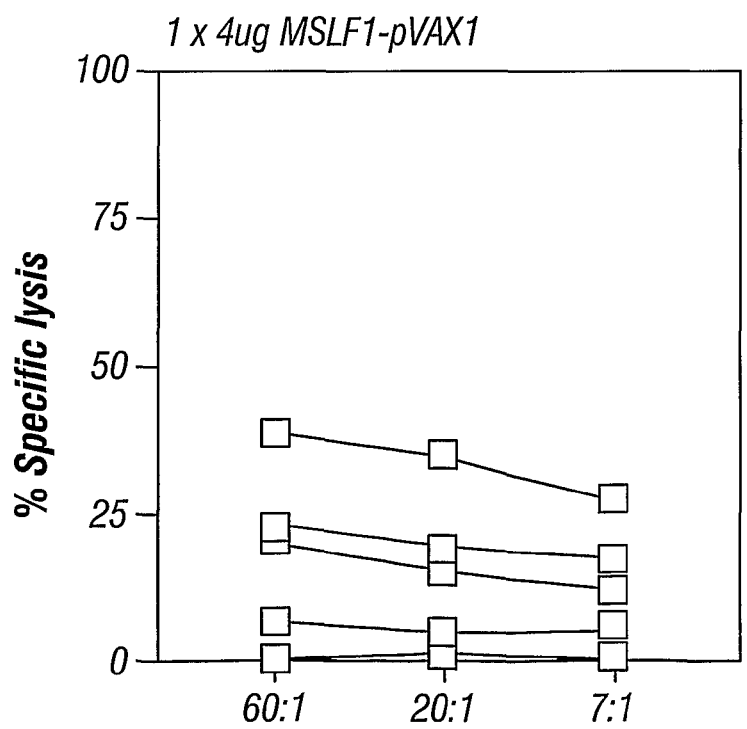
Figure 6I:
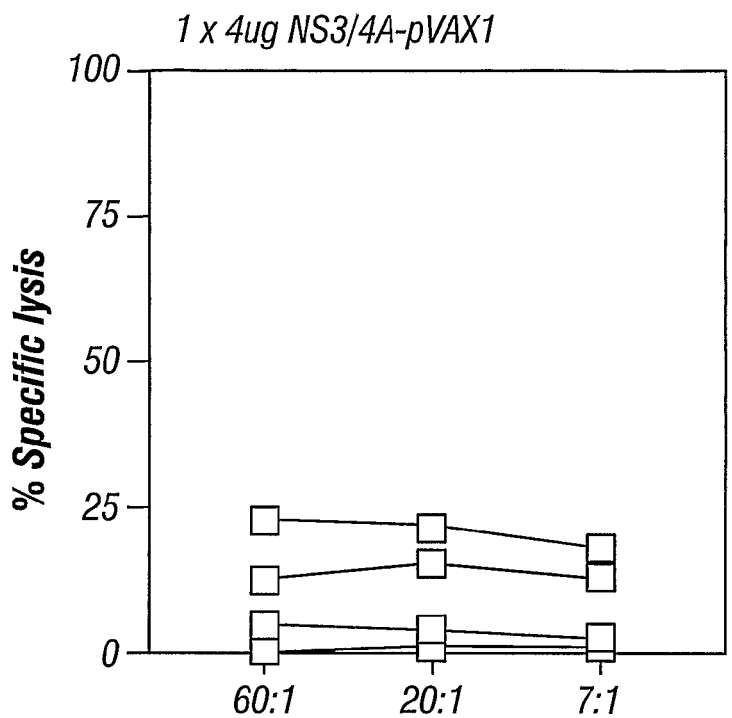
Figure 6J:
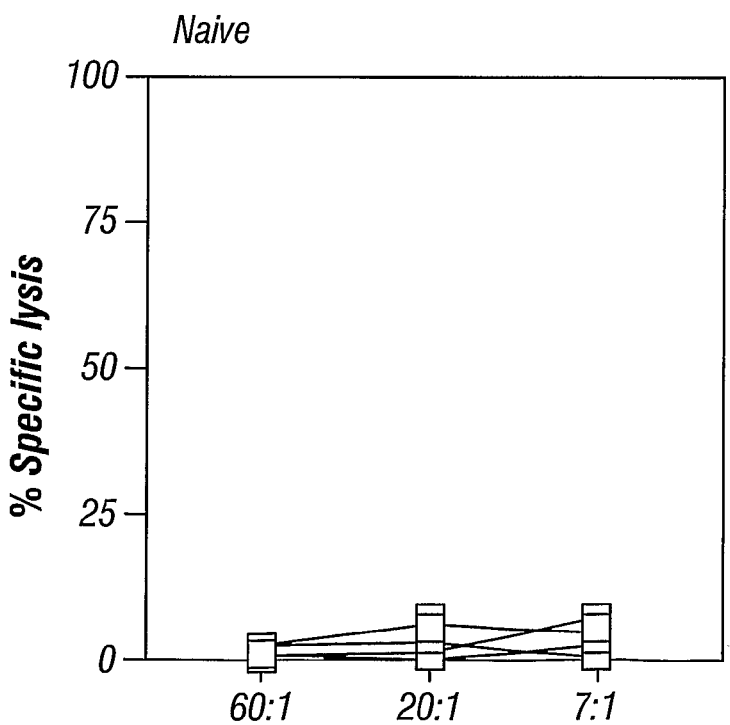
Figure 6K:
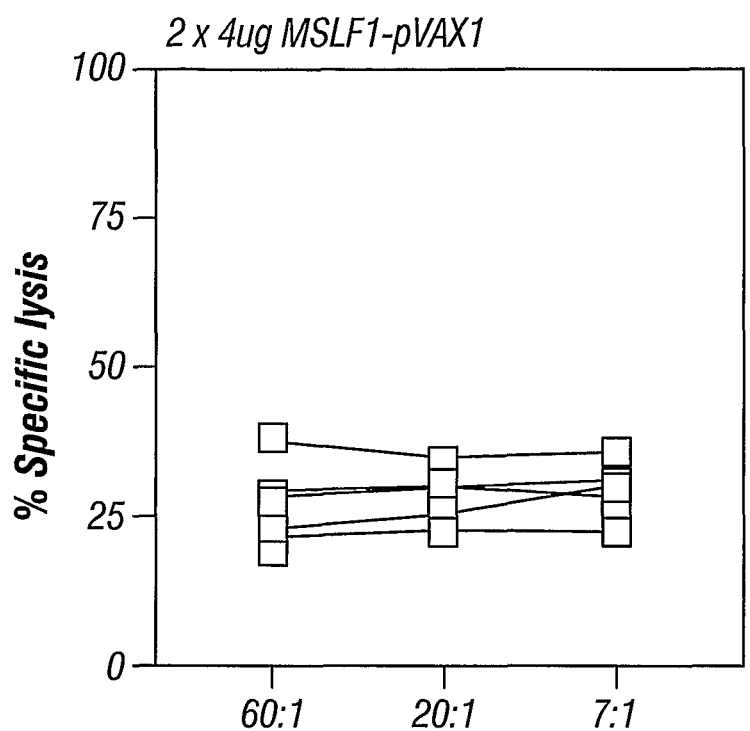
Figure 6L:
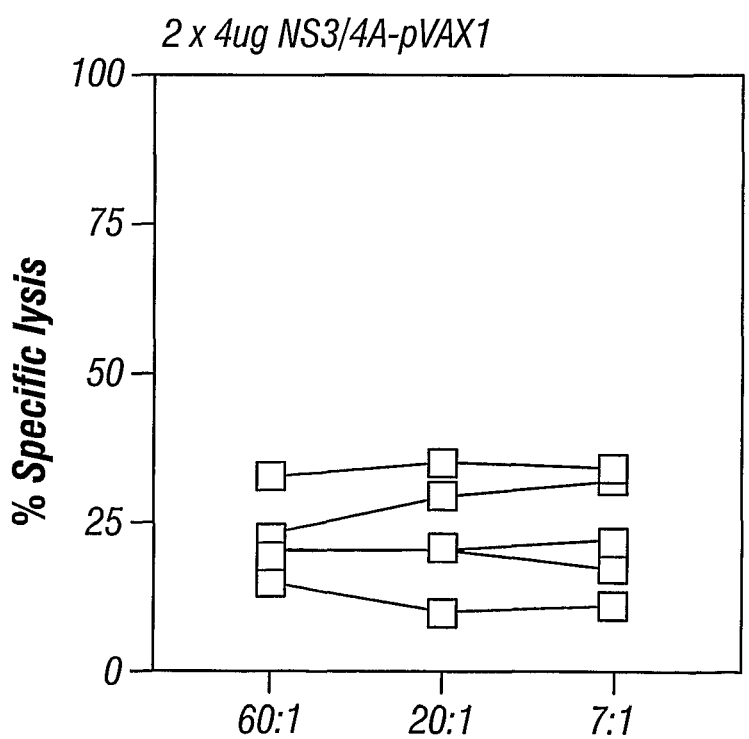

To determine whether NS3-specific T-cells were elicited by the NS3/4A immunizations, an in vitro T-cell mediated tumor cell lysis assay was employed. The assay has been described in detail previously (Sallberg et al., *J. Virol.* 71:5295 (1997)). In a first set of experiments, groups of five Balb/c mice were immunized three times with 100 µg NS3/4A-pVAX i.m. Two weeks after the last injection the mice were sacrificed and splenocytes were harvested. Re-stimulation cultures with $3 \times 10^6$ splenocytes and $3 \times 10^6$ NS3/4A-SP2/0 cells were set. After five days, a standard $Cr^{51}$-release assay was performed using NS3/4A-SP2/0 or SP2/0 cells as targets. Percent specific lysis was calculated as the ratio between lysis of NS3/4A-SP2/0 cells and lysis of SP2/0 cells. Mice immunized with NS3/4A-pVAX displayed specific lysis over 10% in four out of five tested mice, using an effector to target ratio of 20:1 (See FIGS. 5A and 5B).

In a next set of experiments, the T cell responses to MSLF1-pVAX and NS3/4A-pVAX were compared. The ability of the two plasmids to prime in vitro detectable CTLs were evaluated in C57/BL6 mice since an H-2b-restricted NS3 epitope had been previously mapped. Groups of mice were immunized with the two plasmids and CTLs were detected in vitro using either peptide coated H-2b expressing RMA-S cells or NS3/4A-expressing EL-4 cells. Briefly, in vitro stimulation was carried out for five days in 25-ml flasks at a final volume of 12 ml, containing 5 U/ml recombinant murine IL-2 (mIL-2; R&D Systems, Minneapolis, Minn.). The restimulation culture contained a total of $40 \times 10^6$ immune spleen cells and $2 \times 10^6$ irradiated (10,000 rad) syngenic SP2/0 cells expressing the NS3/4A protein. After five days in vitro stimulation a standard $^{51}$Cr-release assay was performed. Effector cells were harvested and a four-hour $^{51}$Cr assay was performed in 96-well U-bottom plates in a total volume of 200 µl. A total of $1 \times 10^6$ target cells was labeled for one hour with 20 µl of $^{51}$Cr (5 mCi/ml) and then washed three times in PBS. Cytotoxic activity was determined at effector:target (E:T) ratios of 40:1, 20:1, and 10:1, using $5 \times 10^3$ $^{51}$Cr-labeled target cells/well.

Alternatively, splenocytes were harvested from C57BL/6 mice 12 days after peptide immunization and were resuspended in RPMI 1640 medium supplemented with 10% FCS, 2 mM L-Glutamine, 10 mM HEPES, 100 U/ml Penicillin and 100 µg/ml Streptomycin, 1 mM non-essential amino acids, 50 µM β-mercaptoethanol, 1 mM sodium pyruvate. In vitro stimulation was carried out for five days in 25 ml flasks in a total volume of 12 ml, containing $25 \times 10^6$ spleen cells and $25 \times 10^6$ irradiated (2,000 rad) syngeneic splenocytes. The restimulation was performed in the presence of 0.05 µM NS3/4A H-2D$^b$ binding peptide (sequence GAVQNEVTL SEQ. ID. NO.: 37) or a control peptide H-2D$^b$ peptide (sequence KAVYNFATM SEQ. ID. NO.: 38). After five days a $^{51}$Cr-release assay was performed. RMA-S target cells were pulsed with 50 µM peptide for 1.5 hrs at +37° C. prior to $^{51}$Cr-labelling, and then washed three times in PBS. Effector cells were harvested and the four hour $^{51}$Cr assay was performed as described. Cytotoxic activity was determined at the E:T ratios 60:1, 20:1, and 7:1 with $5 \times 10^3$ $^{51}$Cr-labeled target cells/well. By these assays, it was determined that the MSLF1 gene primed higher levels of in vitro lytic activity compared to the NS3/4A-pVAX vector. (See FIG. 6A-6L). Similar results were obtained with both the peptide coated H-2b expressing RMA-S cells and NS3/4A-expressing EL-4 cells.

Additional evidence that the codon-optimized MSLF1 gene primed NS3-specific CTLs more effectively than the native NS3/4A gene was obtained using flow cytometry. The frequency of NS3/4A-peptide specific CD8+ T cells were analyzed by ex-vivo staining of spleen cells from NS3/4A DNA immunized mice with recombinant soluble dimeric mouse H-2D$^b$:Ig fusion protein. Many of the monoclonal antibodies and MHC:Ig fusion proteins described herein were purchased from BDB Pharmingen (San Diego, Calif.); Anti-CD16/CD32 (Fc-block™, clone 2.4G2), FITC conjugated anti-CD8 (clone 53-6.7), FITC conjugated anti-H-2K$^b$ (clone AF6-88.5), FITC conjugated anti-H-2D$^b$ (clone KH95), recombinant soluble dimeric mouse H-2D$^b$:Ig, PE conjugated Rat-α Mouse IgG1 (clone X56).

Approximately, $2 \times 10^6$ spleen cells resuspended in 100 µl PBS/1% FCS (FACS buffer) were incubated with 1 µg/$10^6$ cells of Fc-blocking antibodies on ice for 15 minutes. The cells were then incubated on ice for 1.5 hrs with either 2 µg/$10^6$ cells of H-2D$^b$:Ig preloaded for 48 hours at +4° C. with 640 nM excess of NS3/4A derived peptide (sequence GAVQNEVTL SEQ. ID. NO.: 37) or 2 µg/$10^6$ cells of unloaded H-2D$^b$:Ig fusion protein. The cells were then washed twice in FACS buffer and resuspended in 100 µl FACS buffer containing 10 µl/100 µl PE conjugated Rat-α Mouse IgG1 secondary antibody and incubated on ice for 30 minutes. The cells were then washed twice in FACS buffer and incubated with 1 µg/$10^6$ cells of FITC conjugated α-mouse CD8 antibody for 30 minutes. The cells were then washed twice in FACS buffer and resuspended in 0.5 ml FACS buffer containing 0.5 µg/ml of PI. Approximately 200, 000 events from each sample were acquired on a FACS Calibur (BDB) and dead cells (PI positive cells) were excluded from the analysis.

The advantage of quantifying specific CTLs by FACS analysis is that it bypasses the possible disadvantages of in vitro expansion of CTLs in vitro prior to analysis. Direct ex-vivo quantification of NS3-specific CTLs using NS3-peptide loaded divalent H-2D$^b$:Ig fusion protein molecules revealed that the codon optimized MSLF-1 gene primed a effectively primed NS3-specific CTLs already after two immunizations, whereas the original NS3/4A gene did not (Table). Thus, the optimized MSLF-1 gene effectively primes NS3-specific CTLs that are of higher frequency and of better functionality by all parameters tested, as compared to the original NS3/4A gene. The example below provides more evidence that codon optimized NS3/4A efficiently primes NS3 specific cytotoxic T cells.

Example 7A

Initially, the frequency of NS3-specific CTLs that could be primed by gene gun immunization using the wtNS3, wtNS3/

Figure 11A:
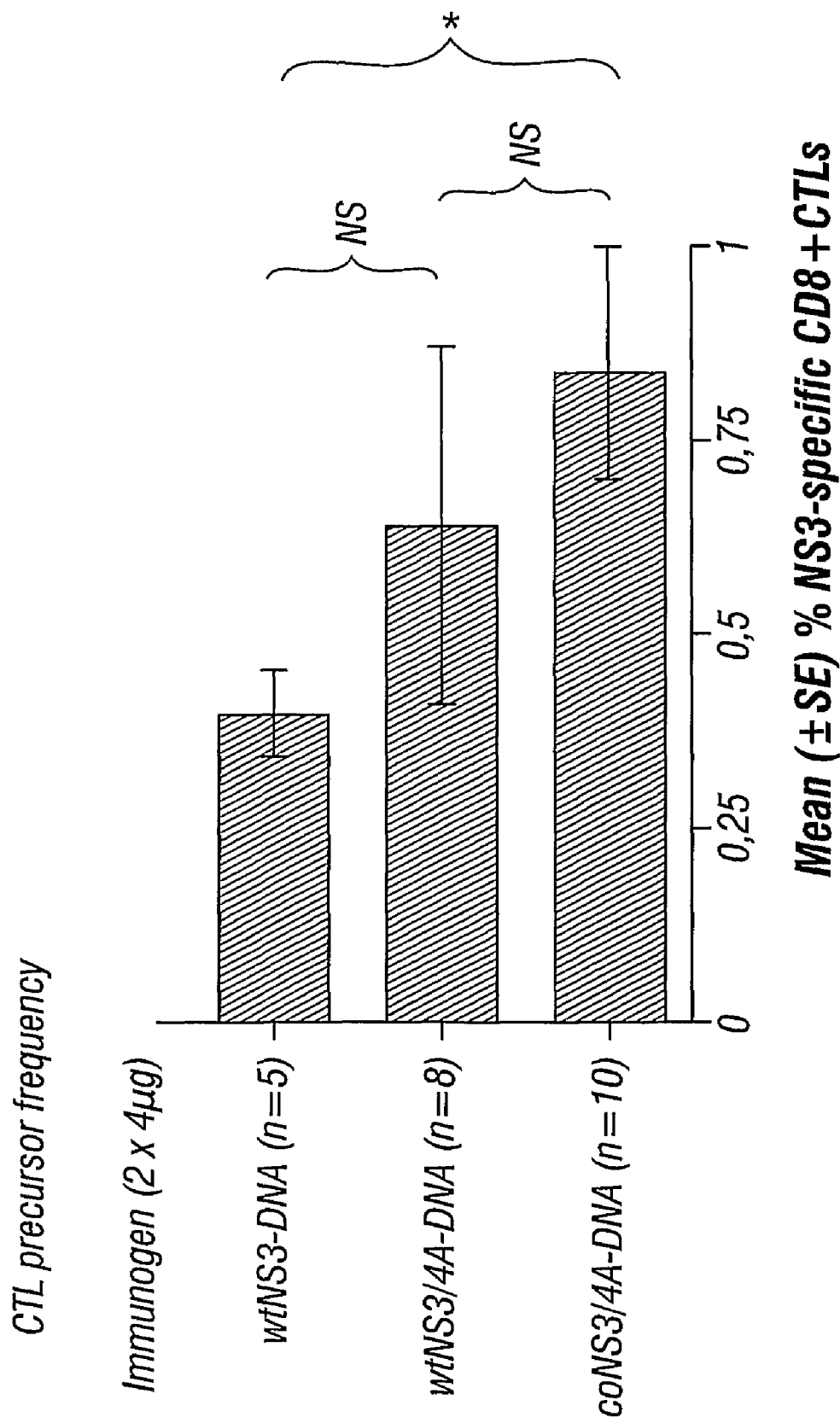
Figure 11B:
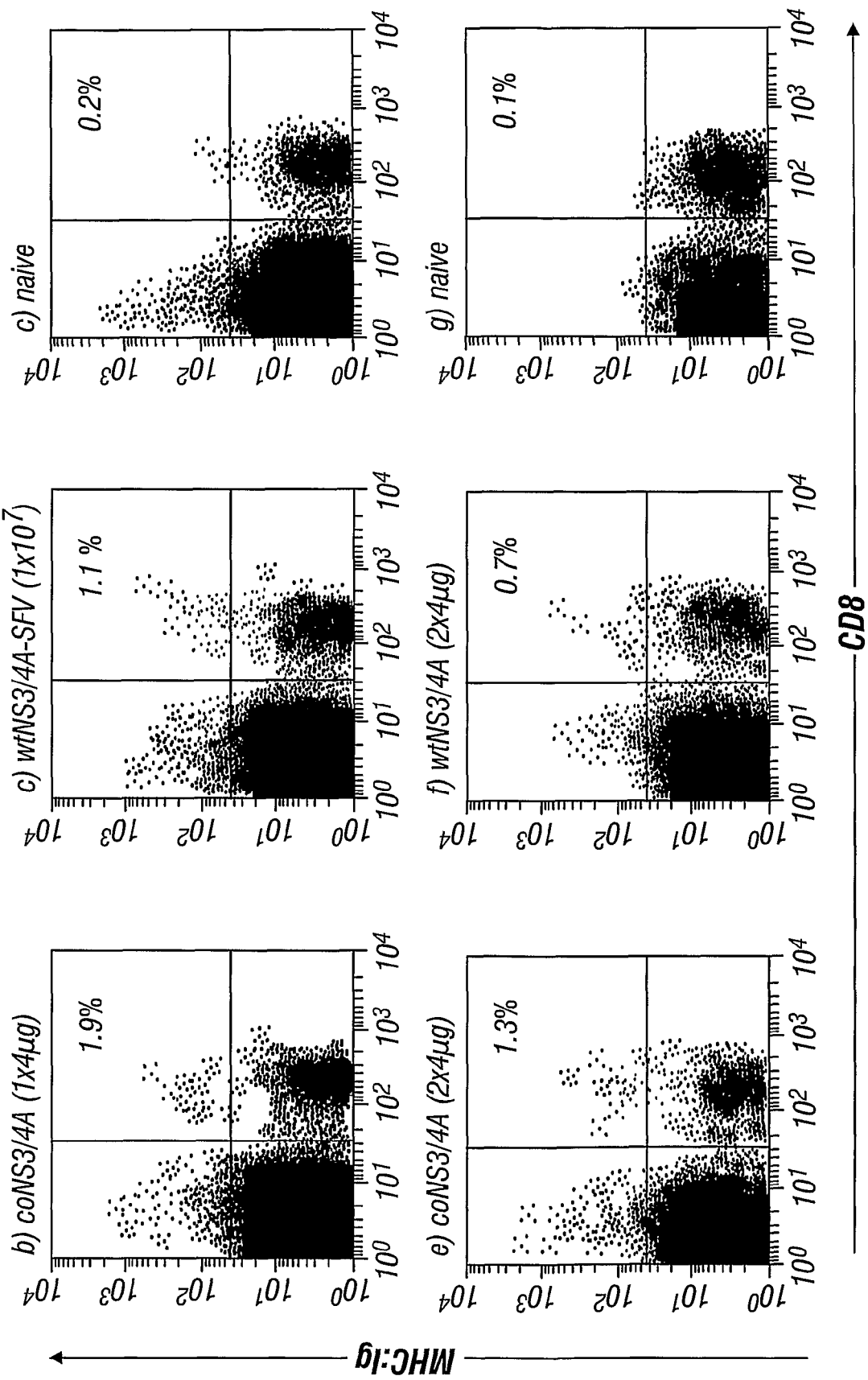
Figure 11B:
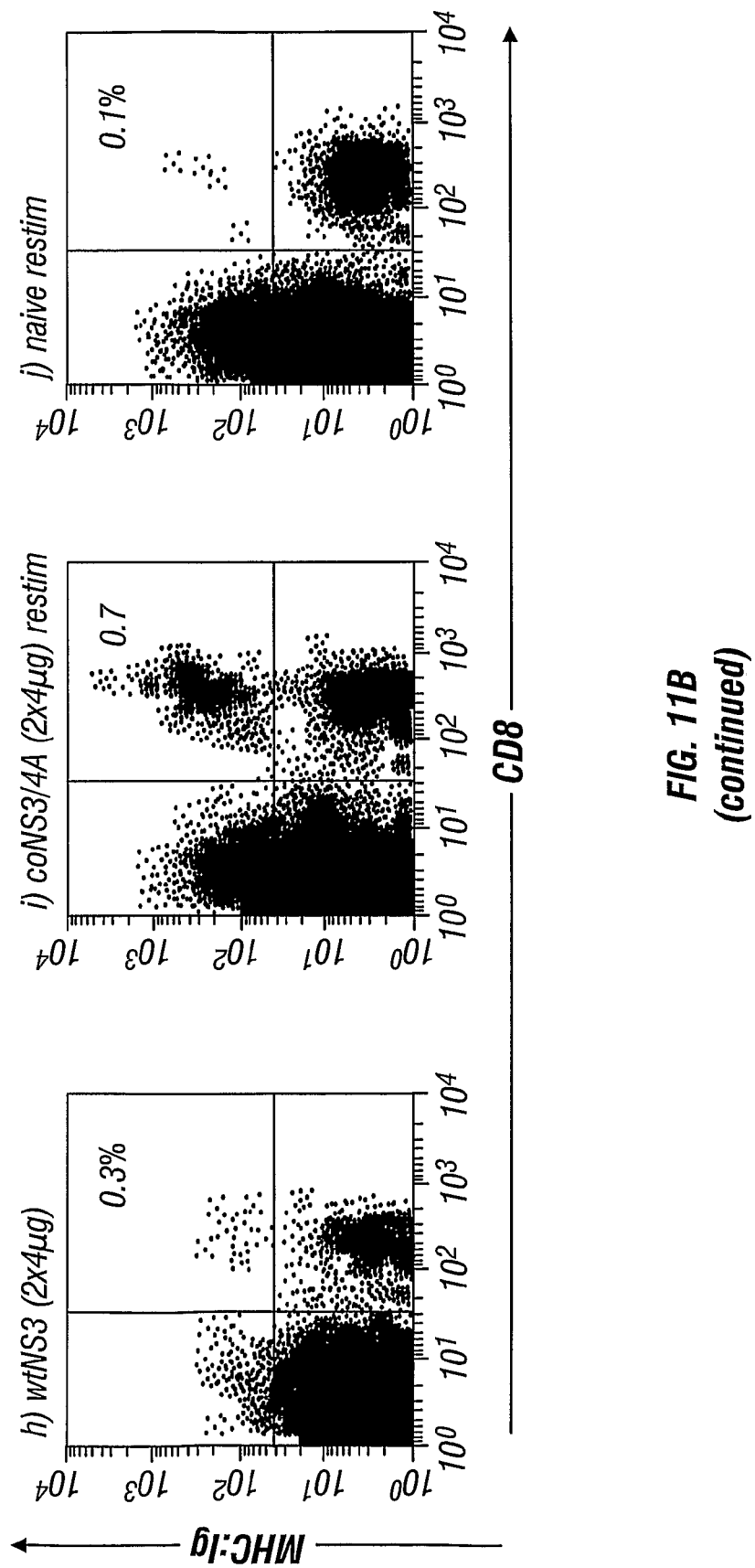

4A and coNS3/4A expressing plasmids was determined. The coNS3/4A plasmid primed higher precursor frequencies of NS3-specific CTL as compared to the wtNS3 gene enforcing the importance of NS4A (FIG. 11). No statistical difference in CTL precursor frequencies was noted between the wtNS3/4A and coNS3/4A expressing plasmids when analyzed directly ex vivo (FIG. 11). A single immunization with the coNS3/4A plasmid or wtNS3/4A-SFV primed around 1% of peptide-specific CTLs within two weeks from immunization (FIG. 11). The specificity of the detection of NS3-specific CTLs was confirmed by a five-day restimulation in vitro with the NS3-peptide, by which high precursor frequencies were observed after immunization with the coNS3/4A gene (FIG. 11).

To directly compare the in vitro lytic activity of the NS3-specific CTLs primed by different vectors, a standard $^{51}$Cr-release assay was performed after one or two immunizations. The lytic activity of the in vivo primed CTLs were assayed on both NS3-peptide loaded H-2D$^b$ expressing RMA-S cells and EL-4 cells stably expressing NS3/4A. After one dose, the coNS3/4A plasmid and the wtNS3/4A-SFV vector was clearly more efficient than the wtNS3/4A plasmid in priming CTLs that lysed NS3-peptide coated target cells (FIG. 12). Thus, the CTL priming event was enhanced by codon optimization or mRNA amplification of the NS3/4A gene. The difference was less clear when using the NS3/4A-expressing EL-4 cells presumably since this assay is less sensitive (FIG. 12). After two immunizations all NS3/4A vectors seemed to prime NS3-specific CTLs with a similar efficiency (FIG. 12). However, two immunizations with any of the NS3/4A-containing vectors were clearly more efficient in priming NS3-specific CTLs as compared to the plasmid containing only the wtNS3 gene (FIG. 12), which is fully consistent with the CTL precursor analysis and previous observations. Thus, codon optimization or mRNA amplification of the NS3/4A gene more rapidly primes NS3-specific CTLs.

Analysis of the inhibition of tumor growth in vivo in BALB/c mice using SP2/0 myeloma cells, or in C57BL/6 mice using EL-4 lymphoma cells, expressing an HCV viral antigen is recognized by those in the field to represent the in vivo functional HCV-specific immune response. (See Encke J et al., J Immunol 161: 4917-4923 (1998)). An SP2/0 cell line stably expressing NS3/4A has previously been described (see Frelin L et al., Gene Ther 10: 686-699 (2003)) and an NS3/4A expressing EL-4 cell line was characterized as described below.

To confirm that inhibition of tumor growth using the NS3/4A-expressing EL-4 cell line is fully dependent on an NS3/4A-specific immune response a control experiment was performed. Groups of ten C57BL/6 mice were either left nonimmunized, or immunized twice with the coNS3/4A plasmid. Two weeks after the last immunization the mice were challenged with an s.c. injection of $10^6$ native EL-4 or NS3/4A-expressing EL-4 cells (NS3/4A-EL-4). An NS3/4A-specific immune response was required for protection, since only the immunized mice were protected against growth of the NS3/4A-EL-4 cell line (FIG. 13). Thus, this H-2$^b$-restricted model behaves similarly to the SP2/0H-2$^d$ restricted model.

Immunizations with recombinant NS3 protein provided evidence that both NS3/4A-specific B cells and CD4+ T cells were not of a pivotal importance in protection against tumor growth. In vitro depletion of CD4+ or CD8+ T cells of splenocytes from coNS3/4A plasmid immunized H-2$^b$ mice provided evidence that CD8+ T cells were the major effector cells in the $^{51}$Cr-release assay. To define the in vivo functional anti-tumor effector cell population, CD4+ or CD8+ T cells in mice immunized with the coNS3/4A plasmid one week prior to, and during, challenge with the NS3/4A-EL-4 tumor cell line were selectively depleted. Analysis by flow cytometry revealed that 85% of CD4+ and CD8+ T cells had been depleted, respectively. This experiment revealed that in vivo depletion of CD4+ T cells had no significant effect on the tumor immunity (FIG. 13). In contrast, depletion of CD8+ T cells in vivo significantly reduced the tumor immunity (p<0.05, ANOVA; FIG. 13). Thus, as expected, NS3/4A-specific CD8+ CTLs seems to be the major protective cell at the effector stage in the in vivo model for inhibition of tumor growth.

The tumor challenge model was then used to evaluate how effective the different immunogens were in priming a protective immunity against growth of NS3/4A-EL-4 tumor cells in vivo. To ensure that the effectiveness of the priming event was studied, all mice were immunized only once. Fully consistent with the in vitro CTL data did we find that only vectors containing NS3/4A were able to rapidly prime protective immune responses as compared to the immunized with the empty pVAX plasmid (p<0.05, ANOVA; FIG. 14). However, this was dependent on NS4A but independent of either codon optimization or mRNA amplification, suggesting that C57BL/6 mice are quite easily protected against tumor growth using genetic immunization.

To further clarify the prerequisites for priming of the in vivo protective CD8+ CTL responses additional experiments were performed. First, C57BL/6 mice immunized with the NS3-derived CTL peptide were not protected against growth of NS3/4A-EL-4 tumors (FIG. 14). Second, immunization with recombinant NS3 in adjuvant did not protect against tumor growth (FIG. 14). NS3-derived CTL peptide effectively primes CTLs in C57BL/6 mice and rNS3 in adjuvant primes high levels of NS3-specific T helper cells. Thus, an endogenous production of NS3/4A seems to be needed to prime in vivo protective CTLs. To further characterize the priming event, groups of B cell (μMT) or CD4 deficient C57BL/6 mice were immunized once with the coNS3/4A gene using gene gun, and were challenged two weeks later (FIG. 14). Since both lineages were protected against tumor growth we conclude that neither B cells nor CD4+ T cells were required for the priming of in vivo functional NS3/4A-specific CTLs (FIG. 14). In conclusion, the priming of in vivo tumor protective NS3/4A-specific CTLs in C57BL/6 mice requires NS4A and an endogenous expression of the immunogen. In C57BL/6 mice the priming is less dependent on the gene delivery route or accessory cells, such as B cells or CD4+ T cells. The fact that the priming of in vivo functional CTL by the coNS3/4A DNA plasmid was independent of CD4+ T helper cells may help to explain the speed by which the priming occurred.

Repeated experiments in C57BL/6 mice using the NS3/4A-EL-4 cell line have shown that protection against tumor growth is obtained already after the first immunization with the NS3/4A gene, independent of codon optimization or mRNA amplification. Also, after two injections the immunity against NS3/4A-EL-4 tumor growth was even further enhanced, but only when NS4A was present. Thus, this model may therefore not be sufficiently sensitive to reveal subtle differences in the intrinsic immunogenicity of different immunogens.

To better compare the immunogenicity of the wtNS3/4A and the coNS3/4A DNA plasmids, additional experiments were performed in H-2$^d$ mice, were at least two immunizations seemed to be required for a tumor protective immunity. It is important to remember that the IgG subclass distribution obtained after gene gun immunization with the NS3/4A gene in BALB/c mice suggested a mixed Th1/Th2-like response.

Thus, it was possible that a Th2-like immunization route (gene gun) in the Th2-prone BALB/c mouse strain may impair the ability to prime in vivo effective CTL responses.

Groups of ten BALB/c mice were immunized once, twice, or thrice with 4 μg of the respective DNA plasmid using the gene gun (FIG. 15). The mice were challenged two weeks after the last injection. Accordingly, these experiments provided more evidence that the coNS3/4A plasmid primed an in vivo functional NS3/4A-specific tumor inhibiting immunity more rapidly than the wild type plasmid (FIG. 15). Two doses of the coNS3/4A primed a significantly better NS3/4A-specific tumor inhibiting immunity as compared to the wtNS3/4A plasmid ($p<0.05$, ANOVA; FIG. 15). After three doses the tumor inhibiting immunity was the same. Thus, the data above verified that the codon optimization of the NS3/4A gene primes NS3-specific CTLs more rapidly.

As set forth herein, the NS3/4A gene can be used as a vaccine. Although it had been determined that NS3/4A quickly primed in vivo functional CTLs, the effect of therapeutic immunization after the injection of tumor cells was analyzed next. Groups of ten C57BL/6 mice were challenged with $10^6$ NS3/4A-EL-4 tumor cells. One group was immunized transdermally with of 4 μg coNS3/4A at six days, and another group at 12 days, after tumor challenge. After the therapeutic vaccination both groups had significantly smaller tumors as compared to the nonimmunized control group ($p<0.01$, respectively, ANOVA; FIG. 16). This confirms that the vaccine rapidly primes CTLs, which are able to home to and infiltrate the NS3/4A-expressing tumors. Thus, gene gun immunization with the coNS3/4A plasmid also works as a therapeutic vaccine. That is, gene gun immunization using the coNS3/4A gene six to 12 days after inoculation of NS3/4A-expressing tumor cells significantly inhibited tumor growth. Overall, a rapid priming of HCV NS3-specific immune responses that are functional in vivo are generated by either DNA based immunization with a codon optimized gene or by mRNA amplification by the SFV replicon. By using these approaches, one can prepare very effective vaccines for the treatment and prevention of chronic HCV infections. The next example described in greater detail some of the materials and methods used in the experiments described herein.

Example 7B

I. Mice

Inbred BALB/c ($H-2^d$) and C57BL/6 ($H-2^b$) mice were obtained from commercial vendors (Möllegard, Denmark). B cell (μMT) deficient mice were kindly provided by Dr Karin Sandstedt, Karolinska Institutet, Sweden. CD4 deficient C57BL/6 mice were obtained from the breeding facility at the Microbiology and Tumorbiology Centre, Karolinska Institutet. All mice were female and were used at 4-8 weeks of age at the start of the experiments.

II. Recombinant NS3 ATPase/Helicase Domain Protein

The recombinant NS3 (rNS3) protein was kindly provided by Darrell L. Peterson, Department of Biochemistry, Commonwealth University, VA. The production of recombinant NS3 protein (not including NS4A) in *E. Coli* has been described in the field. Prior to use the rNS3 protein was dialyzed over night against PBS and sterile filtered.

Generation of a Synthetic Codon Optimized (co) NS3/4A Gene

The sequence of the previously isolated and sequenced unique wtNS3/4A gene was analyzed for codon usage with respect to the most commonly used codons in human cells. A total of 435 nucleotides were replaced to optimize codon usage for human cells. The sequence was sent to Retrogen Inc (San Diego, Calif.) for generation of a full-length synthetic coNS3/4A gene. The coNS3/4A gene had a sequence homology of 79% with the region at nucleotide positions 3417-5475 of the HCV-1 reference strain. A total of 433 nucleotides differed. On an amino acid level the homology with the HCV-1 strain was 98% (15 amino acids differed).

The full-length codon optimized 2.1 kb DNA fragment of the HCV genotype 1b corresponding to the amino acids 1007 to 1711 encompassing the NS3 and NS4A. NS3/NS4A gene fragment was inserted into a Bam HI and Xba I digested pVAX vector (Invitrogen, San Diego) to give the coNS3/4A-pVAX plasmid. The expression construct was sequenced to ensure correct sequence and reading frame. The protein expression was analysed by an in vitro transcription and translation assay. Plasmids were grown in competent TOP10 *E. Coli*. (Invitrogen). Plasmid DNA used for in vivo injection, was purified by using Qiagen DNA purification columns according to the manufacturers instructions (Qiagen GmbH, Hilden, FRG). The concentration of the resulting plasmid DNA was determined spectrophotometrically (Dynaquant, Pharmacia Biotech, Uppsala, Sweden). Purified DNA was dissolved in sterile phosphate buffer saline (PBS) at concentrations of 1 mg/ml.

III. In Vitro Translation Assay

To ensure that the wtNS3/4A and coNS3/4A genes were intact and could be translated, an in vitro transcription assay is using the prokaryotic T7 coupled reticulocyte lysate system (TNT; Promega, Madison, Wis.) was performed. To compare the translation efficiency from the two plasmids the amount input DNA was diluted in serial dilutions (6 ng to 1 ng) prior to addition to the TNT assay.

IV. Transient Transfections

HepG2 cells were transiently transfected by standard protocols. In brief, HepG2 cells were plated into 2.5 cm² wells ($0.5 \times 10^6$) in DMEM medium the day before transfection. Two μg of each plasmid DNA construct (wtNS3/4A and coNS3/4A) was transfected into HepG2 cells using Fugene 6 Transfection Reagent (Roche). After transfection, the HepG2 cells were incubated for 24-48 hrs.

Protein Sample Preparation and Analysis

Cell lysates were analysed by immunoprecipitation followed by SDS-PAGE. In brief, transient transfected HepG2 cells were lysed in RIPA buffer (0.15M NaCl, 50 mM Tris, 1% Triton-X 100, 1% Na-deoxycholate and 1% SDS). The cell lysates were immunoprecipitated with protein A sepharose and anti-NS3 polyclonal antibody overnight at 4° C. The washed pellets were re-suspended in SDS sample buffer, heated at 100° C. for 5 minutes prior to SDS-PAGE analysis on 4-12% Bis-Tris gel (Invitrogen) and electrotransferred onto Nitrocellulose membranes.

Analysis of NS3 Protein Expression

Detection of NS3 protein was done according to manufacturer's protocol by using a chemiluminiscence-linked Western blot kit (WesternBreeze; Invitrogen). NS3 protein expression was detected and quantified as a chemiluminescent signal by using an NS3-specific polyclonal antibody. Chemiluminescent signals were detected by using the GeneGnome (Syngene, Cambridge, UK). Quantification of chemiluminiscence Western blots was performed on GeneGnome and units of intensity from each protein band was calculated and compared to a standard curve of rNS3.

Semlilki Forest Virus (SFV) Vectors

Baby Hamster Kidney (BHK)-21 cells were maintained in complete BHK medium supplemented with 5% FCS, 10% tryptose phosphate broth, 2 mM glutamine, 20 mM Hepes and antibiotics (streptomycin 10 µg/ml and penicillin 100 IU/ml).

The wtNS3/4A gene was isolated by PCR as Spe1-BStB1 fragment and inserted into the Spe1-BstB1 site of pSFV10Enh containing a 34 amino acid long translational enhancer sequence of capsid followed by the FMDV 2a cleavage peptide. Packaging of recombinant RNA into rSFV particles was done using a two-helper RNA system. Indirect immunofluorescence of infected BHK cells was performed to determine the titre of the recombinant virus stocks.

V. Immunofluorescence

BHK cells were transient transfected with coNS3/4A-pVAX1 according to standard techniques using Lipofectamine plus reagent (Invitrogen) or infected by rSFV. NS3 protein was detected by indirect immunofluorescence.

VI. Immunization Protocols

Groups (5-10 mice/group) of female BALB/c ($H-2^d$) or C57BL/6 ($H-2^b$) mice, 4-8 weeks old, were immunized by needle injections of 100 µg of plasmid DNA encoding individual or multiple HCV proteins. Plasmid DNA in PBS was given intramuscularly (i.m.) in the tibialis anterior (TA) muscle. Where indicated in the text, the mice were injected i.m. with 50 µL/TA of 0.01 mM cardiotoxin (Latoxan, Rosans, France) in 0.9% sterile saline NaCl, five days prior to DNA immunization. The mice were boosted at four-week intervals.

For gene gun based immunizations, plasmid DNA was linked to gold particles (1 µm) according to protocols supplied by the manufacturer (Bio-Rad Laboratories, Hercules, Calif.). Prior to immunization the abdominal injection area was shaved and the immunization was performed according to the manufacturer's protocol at a helium discharge pressure of 500 psi. Each injection dose contained 4 µg of plasmid DNA. The mice were boosted with the same dose at monthly intervals.

For rSFV particle immunizations, mice were immunized subcutaneously, in the base of the tail, with $1 \times 10^7$ virus particles diluted in PBS (wtNS3/4A-SFV), in a final volume of 100 µl. Peptide immunization was performed by subcutaneous immunization in the base of the tail with 100 µg peptide mixed 1:1 in complete Freunds adjuvant.

ELISA for Detection of Murine Anti-HCV NS3 Antibodies

Serum for antibody detection and isotyping was collected every second or fourth week after the first immunization by retroorbital bleeding of isofluorane-anesthetized mice. The enzyme immuno assays were performed as previously described.

Cell Lines

The SP2/0-Ag14 myeloma cell line ($H-2^d$) was maintained in DMEM medium supplemented with 10% fetal calf serum (FCS; Sigma Chemicals, St. Louis, Mo.), 2 mM L-Glutamine, 10 mM HEPES, 100 U/ml Penicillin and 100 µg/nl Streptomycin, 1 mM non-essential amino acids, 50 µM β-mercaptoethanol, 1 mM sodium pyruvate (GIBCO-BRL, Gaithesburgh, Md.). SP2/0-Ag14 cells with stable expression of NS3/4A were maintained in 800 µg geneticin (G418)/ml complete DMEM medium.

The EL-4 lymphoma ($H-2^b$) cells were maintained in RPMI 1640 medium supplemented with 10% FCS, 10 mM HEPES, 1 mM sodium pyruvate, 1 mM non-essential amino acids, 50 µM β-mercaptoethanol, 100 U/ml Penicillin and 100 µg/ml Streptomycin (GIBCO-BRL). EL-4 cells with stable expression of NS3/4A were generated by transfection of EL-4 cells with the linearized NS3/4A-pcDNA3.1 plasmid using the SuperFect (Qiagen GmbH, Hilden, FRG) transfection reagent. The transfection procedure was performed according to manufacturer's protocol. Transfected cells were cloned by limiting dilution and selected by addition of 800 µg geneticin (G418)/ml complete RPMI 1640 medium.

RMA-S cells (a kind gift from Professor Klas Kärre, Karolinska Institutet, Sweden) were maintained in RPMI 1640 medium supplemented with 5% FCS, 2 mM L-Glutamin, 100 U/ml Penicillin and 100 µg/ml Streptomycin. All cells were grown in a humidified 37° C., 5% $CO_2$ incubator.

VII. In Vivo Depletion of T Cells

CD4 and CD8 T cell subpopulations were depleted in vivo by intraperitoneal injection of purified hybridoma supernatant. A total of 0.4 mg per mouse per injection of anti-CD4 (clone GK1.5) or anti-CD8 (clone 53-6.7) was injected on days −3, −2, and −1 before tumor challenge, and on days 3, 6, 10, and 13 after challenge. Flow cytometric analysis of peripheral blood mononuclear cell populations at days 0, 3, 6, 10, and 13 demonstrated that more than 85% of the CD4 and CD8 T cells were depleted.

In Vivo Challenge with the NS3/4A-Expressing Tumor Cells

In vivo challenge of immunized mice with the NS3/4A-expressing SP2/0 myeloma or EL-4 lymphoma cell line was performed according to the method described by Encke et al., supra. In brief, groups of BALB/c or C57BL/6 mice were immunized with different immunogens at weeks zero, four, and eight as described. Two weeks after the last immunisation $1 \times 10^6$ NS3/4A-expressing SP2/0 or EL-4 cells were injected subcutaneously in the right flank. The kinetics of the tumor growth was determined by measuring the tumor size through the skin at days six to 20. Kinetic tumor development in two groups of mice was compared using the area under the curve (AUC). The mean tumor sizes were compared using the analysis of variance (ANOVA) test. At day 20 all mice were sacrificed.

To test the therapeutic effect of the vaccines groups of mice were inoculated with the tumor cells as described above. After six or 12 days the mice were immunized once. The tumor growth was monitored from day 6 to day 20.

Antibodies and MHC:Ig Fusion Protein

All monoclonal antibodies and MHC:Ig fusion proteins were purchased from BDB Pharmingen (San Diego, Calif.); Anti-CD16/CD32 (Fc-block™, clone 2.4G2), FITC conjugated anti-CD8 (clone 53-6.7), Cy-Chrome conjugated anti-CD4 (clone RM4-5), FITC conjugated anti-$H-2D^b$ (clone KH95), recombinant soluble dimeric mouse $H-2D^b$:Ig, PE conjugated Rat-α Mouse IgG1 (clone X56).

VIII. Detection of NS3/4A-Specific CTL Activity

Spleen cells from DNA or rSFV immunized C57BL/6 mice were resuspended in complete RPMI 1640 medium supplemented with 10% FCS, 2 mM L-Glutamine, 10M HEPES, 100 U/ml Penicillin and 100 µg/ml Streptomycin, 1 mM non-essential amino acids, 50 μM β-mercaptoethanol, 1 mM sodium pyruvate. In vitro stimulation was carried out for five days in 25-ml flasks at a final volume of 12 ml, containing 5 U/ml recombinant murine IL-2 (mIL-2; R&D Systems, Minneapolis, Minn., USA). The restimulation culture contained a total of $25\times10^6$ immune spleen cells and $2.5\times10^6$ irradiated (10,000 rad) syngenic EL-4 cells expressing the NS3/4A protein. After five days in vitro stimulation a standard $^{51}$Cr-release assay was performed. Effector cells were harvested and a four-hour $^{51}$Cr assay was performed in 96-well U-bottom plates in a total volume of 200 μl. A total of $1\times10^6$ target cells (NS3/4A expressing EL-4 cells) was labelled for one hour at +37° C. with 20 μl of $^{51}$Cr (5 mCi/ml) and then washed three times in PBS. Different numbers of effectors and $^{51}$Cr-labeled target cells ($5\times10^3$ cells/well) were added to wells at effector:target (E:T) ratios of 60:1, 20:1, and 7:1. The level of cytolytic activity was determined after incubation of effectors and targets for 4 hour at +37° C. 100 μl supernatant was harvested and the radioactivity was measured with a γ-counter.

Splenocytes from DNA or rSFV immunised mice were harvested from C57BL/6 mice and were resuspended in complete RPMI 1640 medium as previously described. In brief, in vitro stimulation was carried out for five days by mixing $25\times10^6$ spleen cells and $25\times10^6$ irradiated (2,000 rad) syngeneic splenocytes. The restimulation was performed in the presence of 0.05 μM NS3/4A H-2D$^b$ binding peptide (sequence GAVQNEVTL (Seq. Id. No. 37)). After restimulation, a four hour $^{51}$Cr-release assay was performed using $^{51}$Cr-labelled peptide pulsed RMA-S cells as targets. Cytotoxic activity was determined at the E:T ratios 60:1, 20:1, and 7:1.

Results were expressed according to the formula: percent specific lysis=(experimental release–spontaneous release)/(maximum release–spontaneous release). Experimental release is the mean counts/minute released by the target cells in presence of effector cells. Maximum release is the radioactivity released after lysis of target cells with 10% Triton X-100. Spontaneous release is the leakage of radioactivity into the medium of target cells.

In vitro T-cell depletion experiments were conducted by incubating effector cells with either an anti-CD4, or anti-CD8, monoclonal antibody containing hybridoma supernatant (clone RL 172.4; anti-CD4, or clone 31M; anti-CD8) for 30 minutes at 4° C. The cells were then washed and incubated at 37° C. for 1 hr with complement (1/20 dilution of low toxicity rabbit complement; Saxon, UK) before performing the CTL assay described above.

Quantification of NS3/4A-Specific CTLs by Flow Cytometry

The frequency of NS3-peptide specific CD8+ T cells were analysed by ex-vivo staining of spleen cells from DNA or rSFV immunized mice with recombinant soluble dimeric mouse H-2D$^b$:Ig fusion protein as previously described. In brief, spleen cells were resuspended in PBS/1% FCS (FACS buffer) and incubated with Fc-blocking antibodies. Cells were then washed and incubated with H-2D$^b$:Ig preloaded with NS3/4A derived peptide. Afterwards, cells were washed and incubated with PE conjugated Rat-α Mouse IgG1 antibody, FITC conjugated α-mouse CD8 antibody and Cy-Chrome α-mouse CD4 antibody. After washing, the cells were diluted in FACS buffer containing Propidium Iodide (PI). Approximately 200,000 total events from each sample were acquired on a FACSCalibur (BDB) and dead cells (PI positive cells) were excluded in the analysis.

IX. Statistical Analysis

Fisher's exact test was used for frequency analysis and Mann-Whitney U-test was used for comparing values from two groups. Kinetic tumor development in two groups of mice was compared using the area under the curve (AUC). AUC values were compared using analysis of variance (ANOVA). The calculations were performed using the Macintosh version of the StatView software (version 5.0).

The next section describes some of the peptide embodiments of the invention.

HCV Peptides

The embodied HCV peptides or derivatives thereof, include but are not limited to, those containing as a primary amino acid sequence all of the amino acid sequence substantially as depicted in the Sequence Listing (SEQ. ID. NOs.: 2-11, 36, and SEQ ID NOs: 40-220) and fragments of SEQ. ID. NOs.: 2-11 and SEQ. ID. NO.: 36 that are at least four amino acids in length (e.g., SEQ. ID. NOs.: 14-16) including altered sequences in which functionally equivalent amino acid residues are substituted for residues within the sequence resulting in a silent change. Preferred fragments of a sequence of SEQ. ID. NOs.: 2-11 and SEQ. ID. NO.: 36 are at least four amino acids and comprise amino acid sequence unique to the discovered NS3/4A peptide or mutants thereof including altered sequences in which functionally equivalent amino acid residues are substituted for residues within the sequence resulting in a silent change. The HCV peptides can be, for example, at least 12-704 amino acids in length (e.g., any number between 12-15, 15-20, 20-25, 25-50, 50-100, 100-150, 150-250, 250-500 or 500-704 amino acids in length).

Embodiments also include HCV peptides that are substantially identical to those described above. That is, HCV peptides that have one or more amino acid residues within SEQ. ID. NOs.: 2-11, 36, and 40-220 and fragments thereof that are substituted by another amino acid of a similar polarity that acts as a functional equivalent, resulting in a silent alteration. Further, the HCV peptides can have one or more amino acid residues fused to SEQ. ID. NOs.: 2-11, 36 and SEQ ID NO: 40-220 or a fragment thereof so long as the fusion does not significantly alter the structure or function (e.g., immunogenic properties) of the HCV peptide. Substitutes for an amino acid within the sequence can be selected from other members of the class to which the amino acid belongs. For example, the non-polar (hydrophobic) amino acids include alanine, leucine, isoleucine, valine, proline, phenylalanine, tryptophan, and methionine. The polar neutral amino acids include glycine, serine, threonine, cysteine, tyrosine, asparagine and glutamine. The positively charged (basic) amino acids include arginine, lysine, and histidine. The negatively charged (acidic) amino acids include aspartic acid and glutamic acid. The aromatic amino acids include phenylalanine, tryptophan, and tyrosine. Accordingly, the peptide embodiments of the invention are said to be consisting essentially of SEQ. ID. NOs.: 2-27, 36 and SEQ ID NOs: 40-220 in light of the modifications described above.

The HCV peptides described herein can be prepared by chemical synthesis methods (such as solid phase peptide synthesis) using techniques known in the art such as those set forth by Merrifield et al., *J. Am. Chem. Soc.* 85:2149 (1964), Houghten et al., *Proc. Natl. Acad. Sci. USA,* 82:51:32 (1985), Stewart and Young (*Solid phase peptide synthesis*, Pierce Chem. Co., Rockford, Ill. (1984), and Creighton, 1983, *Proteins: Structures and Molecular Principles*, W. H. Freeman & Co., N.Y. Such polypeptides can be synthesized with or without a methionine on the amino terminus. Chemically synthesized HCV peptides can be oxidized using methods set forth in these references to form disulfide bridges.

While the HCV peptides described herein can be chemically synthesized, it can be more effective to produce these polypeptides by recombinant DNA technology. Such methods can be used to construct expression vectors containing the HCV nucleotide sequences described above, for example, and appropriate transcriptional and translational control signals. These methods include, for example, in vitro recombinant DNA techniques, synthetic techniques, and in vivo genetic recombination. Alternatively, RNA capable of encoding an HCV nucleotide sequence can be chemically synthesized using, for example, synthesizers. See, for example, the techniques described in *Oligonucleotide Synthesis,* 1984, Gait, M. J. ed., IRL Press, Oxford. Accordingly, several embodiments concern cell lines that have been engineered to express the embodied HCV peptides. For example, some cells are made to express the HCV peptides of SEQ. ID. NOs.: 2-11, 36 and SEQ ID NOs: 40-220 or fragments of these molecules (e.g., SEQ. ID. NOs.: 14-26).

A variety of host-expression vector systems can be utilized to express the embodied HCV peptides. Suitable expression systems include, but are not limited to, microorganisms such as bacteria (e.g., *E. coli* or *B. subtilis*) transformed with recombinant bacteriophage DNA, plasmid DNA or cosmid DNA expression vectors containing HCV nucleotide sequences; yeast (e.g., *Saccharomyces, Pichia*) transformed with recombinant yeast expression vectors containing the HCV nucleotide sequences; insect cell systems infected with recombinant virus expression vectors (e.g., baculovirus) containing the HCV sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing HCV sequences; or mammalian cell systems (e.g., COS, CHO, BHK, 293, 3T3) harboring recombinant expression constructs containing promoters derived from the genome of mammalian cells (e.g., metallothionein promoter) or from mammalian viruses (e.g., the adenovirus late promoter; the vaccinia virus 7.5K promoter).

In bacterial systems, a number of expression vectors can be advantageously selected depending upon the use intended for the HCV gene product being expressed. For example, when a large quantity of such a protein is to be produced, for the generation of pharmaceutical compositions of HCV peptide or for raising antibodies to the HCV peptide, for example, vectors which direct the expression of high levels of fusion protein products that are readily purified can be desirable. Such vectors include, but are not limited, to the *E. coli* expression vector pUR278 (Ruther et al., *EMBO J.,* 2:1791 (1983), in which the HCV coding sequence can be ligated individually into the vector in frame with the lacZ coding region so that a fusion protein is produced; pIN vectors (Inouye & Inouye, *Nucleic Acids Res.,* 13:3101-3109 (1985); Van Heeke & Schuster, *J. Biol. Chem.,* 264:5503-5509 (1989)); and the like. The pGEX vectors can also be used to express foreign polypeptides as fusion proteins with glutathione S-transferase (GST). In general, such fusion proteins are soluble and can be purified from lysed cells by adsorption to glutathione-agarose beads followed by elution in the presence of free glutathione. The PGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The HCV coding sequence can be cloned individually into non-essential regions (for example the polyhedrin gene) of the virus and placed under control of an AcNPV promoter (for example the polyhedrin promoter). Successful insertion of an HCV gene coding sequence will result in inactivation of the polyhedrin gene and production of non-occluded recombinant virus, (i.e., virus lacking the proteinaceous coat coded for by the polyhedrin gene). These recombinant viruses are then used to infect *Spodoptera frugiperda* cells in which the inserted gene is expressed. (See e.g., Smith et al., *J. Virol.* 46: 584 (1983); and Smith, U.S. Pat. No. 4,215,051).

In mammalian host cells, a number of viral-based expression systems can be utilized. In cases where an adenovirus is used as an expression vector, the HCV nucleotide sequence of interest can be ligated to an adenovirus transcription/translation control complex, e.g., the late promoter and tripartite leader sequence. This chimeric gene can then be inserted in the adenovirus genome by in vitro or in vivo recombination. Insertion in a non-essential region of the viral genome (e.g., region E1 or E3) will result in a recombinant virus that is viable and capable of expressing the HCV gene product in infected hosts. (See e.g., Logan & Shenk, *Proc. Natl. Acad. Sci. USA* 81:3655-3659 (1984)). Specific initiation signals can also be required for efficient translation of inserted HCV nucleotide sequences. These signals include the ATG initiation codon and adjacent sequences.

However, in cases where only a portion of the HCV coding sequence is inserted, exogenous translational control signals, including, perhaps, the ATG initiation codon, can be provided. Furthermore, the initiation codon can be in phase with the reading frame of the desired coding sequence to ensure translation of the entire insert. These exogenous translational control signals and initiation codons can be of a variety of origins, both natural and synthetic. The efficiency of expression can be enhanced by the inclusion of appropriate transcription enhancer elements, transcription terminators, etc. (See Bittner et al., *Methods in Enzymol.,* 153:516-544 (1987)).

In addition, a host cell strain can be chosen, which modulates the expression of the inserted sequences, or modifies and processes the gene product in the specific fashion desired. Such modifications (e.g., glycosylation) and processing (e.g., cleavage) of protein products are important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells that possess the cellular machinery for proper processing of the primary transcript, glycosylation, and phosphorylation of the gene product can be used. Such mammalian host cells include, but are not limited to, CHO, VERO, BHK, HeLa, COS, MDCK, 293, 3T3, and WI38.

For long-term, high-yield production of recombinant proteins, stable expression is preferred. For example, cell lines that stably express the HCV peptides described above can be engineered. Rather than using expression vectors that contain viral origins of replication, host cells can be transformed with DNA controlled by appropriate expression control elements (e.g., promoter, enhancer sequences, transcription terminators, polyadenylation sites, etc.), and a selectable marker. Following the introduction of the foreign DNA, engineered cells are allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn are cloned and expanded into cell lines. This method is advantageously used to engineer cell lines which express the HCV gene product.

A number of selection systems can be used, including but not limited to the herpes simplex virus thymidine kinase (Wigler, et al., *Cell* 11:223 (1977), hypoxanthine-guanine phosphoribosyltransferase (Szybalska & Szybalski, *Proc. Natl. Acad. Sci. USA* 48:2026 (1962)), and adenine phosphoribosyltransferase (Lowy, et al., *Cell* 22:817 (1980)) genes can be employed in tk⁻, hgprt⁻ or aprt⁻ cells, respectively. Also, antimetabolite resistance can be used as the basis of selection for the following genes: dhfr, which confers resistance to methotrexate (Wigler, et al., *Proc. Natl. Acad. Sci. USA* 77:3567 (1980); O'Hare, et al., *Proc. Natl. Acad. Sci. USA* 78:1527 (1981)); gpt, which confers resistance to mycophenolic acid (Mulligan & Berg, *Proc. Natl. Acad. Sci. USA* 78:2072 (1981)); neo, which confers resistance to the aminoglycoside G-418 (Colberre-Garapin, et al., *J. Mol. Biol.* 150:1 (1981)); and hygro, which confers resistance to hygromycin (Santerre, et al., *Gene* 30:147 (1984)).

Alternatively, any fusion protein can be readily purified by utilizing an antibody specific for the fusion protein being expressed. For example, a system described by Janknecht et al. allows for the ready purification of non-denatured fusion proteins expressed in human cell lines. (Janknecht, et al., *Proc. Natl. Acad. Sci. USA* 88: 8972-8976 (1991)). In this system, the gene of interest is subcloned into a vaccinia recombination plasmid such that the gene's open reading frame is translationally fused to an amino-terminal tag consisting of six histidine residues. Extracts from cells infected with recombinant vaccinia virus are loaded onto $Ni^{2+}$ nitriloacetic acid-agarose columns and histidine-tagged proteins are selectively eluted with imidazole-containing buffers. The example below describes a method that was used to express the HCV peptides encoded by the embodied nucleic acids.

Example 8

To characterize NS3/4A-pVAX, MSLF1-pVAX, and the NS3/4A mutant constructs, described in Example 1, the plasmids were transcribed and translated in vitro, and the resulting polypeptides were visualized by sodium dodecyl sulfate-polyacrylamide gel electrophoresis (SDS-PAGE). In vitro transcription and translation were performed using the T7 coupled reticulocyte lysate system (Promega, Madison, Wis.) according to the manufacturer's instructions. All in vitro translation reactions of the expression constructs were carried out at 30° C. with $^{35}$S-labeled methionine (Amersham International, Plc, Buckinghamshire, UK). The labeled proteins were separated by 12% SDS-PAGE and visualized by exposure to X-ray film (Hyper Film-MP, Amersham) for 6-18 hours.

The in vitro analysis revealed that all proteins were expressed to high amounts from their respective expression constructs. The rNS3 construct (NS3-pVAX vector) produced a single peptide of approximately 61 kDa, whereas, the mutant constructs (e.g., the TGT construct (NS3/4A-TGT-pVAX) and the RGT construct (NS3/4A-RGT-pVAX)) produced a single polypeptide of approximately 67 kDa, which is identical to the molecular weight of the uncleaved NS3/4A peptide produced from the NS3/4A-pVAX construct. The cleaved product produced from the expressed NS3/4A peptide was approximately 61 kDa, which was identical in size to the rNS3 produced from the NS3-pVAX vector. These results demonstrated that the expression constructs were functional, the NS3/4A construct was enzymatically active, the rNS3 produced a peptide of the predicted size, and the breakpoint mutations completely abolished cleavage at the NS3-NS4A junction.

To compare the translation efficiency from the NS3/4A-pVAX and MSLF1-pVAX plasmids, the amount of input DNA was serially diluted prior to addition to the assay. Serial dilutions of the plasmids revealed that the MSLF1 plasmid gave stronger bands at higher dilutions of the plasmid than the wild-type NS3/4A plasmid, providing evidence that in vitro transcription and translation was more efficient from the MSLF1 plasmid. The NS3/4A-pVAX and MSLF1 plasmids were then analyzed for protein expression using transiently transfected Hep-G2 cells. Similar results were obtained in that the MSLF-1 gene provided more efficient expression of NS3 than the native NS3/4A gene.

The sequences, constructs, vectors, clones, and other materials comprising the embodied HCV nucleic acids and peptides can be in enriched or isolated form. As used herein, "enriched" means that the concentration of the material is many times its natural concentration, for example, at least about 2, 5, 10, 100, or 1000 times its natural concentration, advantageously 0.01%, by weight, preferably at least about 0.1% by weight. Enriched preparations from about 0.5% or more, for example, 1%, 5%, 10%, and 20% by weight are also contemplated. The term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated. It is also advantageous that the sequences be in purified form. The term "purified" does not require absolute purity; rather, it is intended as a relative definition. Isolated proteins have been conventionally purified to electrophoretic homogeneity by Coomassie staining, for example. Purification of starting material or natural material to at least one order of magnitude, preferably two or three orders, and more preferably four or five orders of magnitude is expressly contemplated.

The HCV gene products described herein can also be expressed in plants, insects, and animals so as to create a transgenic organism. Desirable transgenic plant systems having an HCV peptide include *Arabadopsis*, maize, and *Chlamydomonas*. Desirable insect systems having an HCV peptide include, but are not limited to, *D. melanogaster* and *C. elegans*. Animals of any species, including, but not limited to, amphibians, reptiles, birds, mice, hamsters, rats, rabbits, guinea pigs, pigs, micro-pigs, goats, dogs, cats, and non-human primates, e.g., baboons, monkeys, and chimpanzees can be used to generate transgenic animals having an embodied HCV molecule. These transgenic organisms desirably exhibit germline transfer of HCV peptides described herein.

Any technique known in the art is preferably used to introduce the HCV transgene into animals to produce the founder lines of transgenic animals or to knock out or replace existing HCV genes. Such techniques include, but are not limited to pronuclear microinjection (Hoppe, P. C. and Wagner, T. E., 1989, U.S. Pat. No. 4,873,191); retrovirus mediated gene transfer into germ lines (Van der Putten et al., *Proc. Natl. Acad. Sci., USA* 82:6148-6152 (1985)); gene targeting in embryonic stem cells (Thompson et al., *Cell* 56:313-321 (1989)); electroporation of embryos (Lo, *Mol Cell. Biol.* 3:1803-1814 (1983); and sperm-mediated gene transfer (Lavitrano et al., *Cell* 57:717-723 (1989)); see also Gordon, *Transgenic Animals, Intl. Rev. Cytol.* 115:171-229 (1989).

Following synthesis or expression and isolation or purification of the HCV peptides, the isolated or purified peptide can be used to generate antibodies. Depending on the context, the term "antibodies" can encompass polyclonal, monoclonal, chimeric, single chain, Fab fragments and fragments produced by a Fab expression library. Antibodies that recognize the HCV peptides have many uses including, but not limited to, biotechnological applications, therapeutic/prophylactic applications, and diagnostic applications.

For the production of antibodies, various hosts including goats, rabbits, rats, mice, and humans etc. can be immunized by injection with an HCV peptide. Depending on the host species, various adjuvants can be used to increase immunological response. Such adjuvants include, but are not limited to, ribavirin, Freund's, mineral gels such as aluminum hydroxide, and surface active substances such as lysolecithin, pluronic polyols, polyanions, peptides, oil emulsions, keyhole limpet hemocyanin, and dinitrophenol. BCG (*Bacillus* Calmette-Guerin) and *Corynebacterium parvum* are also potentially useful adjuvants.

Peptides used to induce specific antibodies can have an amino acid sequence consisting of at least four amino acids, and preferably at least 10 to 15 amino acids. By one approach, short stretches of amino acids encoding fragments of NS3/4A are fused with those of another protein such as keyhole limpet hemocyanin such that an antibody is produced against the chimeric molecule. Additionally, a composition comprising ribavirin and an HCV peptide (SEQ. ID. NOs.: 2-11, 40-220 and SEQ. ID. NO.: 36), a fragment thereof containing any number of consecutive amino acids between at least 3-50 (e.g., 3, 4, 6, 8, 10, 12, 15, 20, 25, 30, 35, 40, 45, or 50 amino acids) (e.g., SEQ. ID. NOs.: 4-26), or a nucleic acid encoding one or more of these molecules is administered to an animal, preferably a mammal including a human. While antibodies capable of specifically recognizing HCV can be generated by injecting synthetic 3-mer, 10-mer, and 15-mer peptides that correspond to an HCV peptide into mice, a more diverse set of antibodies can be generated by using recombinant HCV peptides, prepared as described above.

To generate antibodies to an HCV peptide, substantially pure peptide is isolated from a transfected or transformed cell. The concentration of the peptide in the final preparation is adjusted, for example, by concentration on an Amicon filter device, to the level of a few micrograms/ml. Monoclonal or polyclonal antibody to the peptide of interest can then be prepared as follows:

Monoclonal antibodies to an HCV peptide can be prepared using any technique that provides for the production of antibody molecules by continuous cell lines in culture. These include, but are not limited to, the hybridoma technique originally described by Koehler and Milstein (*Nature* 256:495-497 (1975)), the human B-cell hybridoma technique (Kosbor et al. *Immunol Today* 4:72 (1983)); Cote et al *Proc Natl Acad Sci* 80:2026-2030 (1983), and the EBV-hybridoma technique Cole et al. *Monoclonal Antibodies and Cancer Therapy*, Alan R. Liss Inc, New York N.Y., pp 77-96 (1985). In addition, techniques developed for the production of "chimeric antibodies", the splicing of mouse antibody genes to human antibody genes to obtain a molecule with appropriate antigen specificity and biological activity can be used. (Morrison et al. *Proc Natl Acad Sci* 81:6851-6855 (1984); Neuberger et al. *Nature* 312:604-608 (1984); Takeda et al. *Nature* 314:452-454 (1985)). Alternatively, techniques described for the production of single chain antibodies (U.S. Pat. No. 4,946,778) can be adapted to produce HCV-specific single chain antibodies. Antibodies can also be produced by inducing in vivo production in the lymphocyte population or by screening recombinant immunoglobulin libraries or panels of highly specific binding reagents as disclosed in Orlandi et al., *Proc Natl Acad Sci* 86: 3833-3837 (1989), and Winter G. and Milstein C; *Nature* 349:293-299 (1991).

Antibody fragments that contain specific binding sites for an HCV peptide can also be generated. For example, such fragments include, but are not limited to, the F(ab')$_2$ fragments that can be produced by pepsin digestion of the antibody molecule and the Fab fragments that can be generated by reducing the disulfide bridges of the F(ab')$_2$ fragments. Alternatively, Fab expression libraries can be constructed to allow rapid and easy identification of monoclonal Fab fragments with the desired specificity. (Huse W. D. et al. *Science* 256:1275-1281 (1989)).

By one approach, monoclonal antibodies to an HCV peptide are made as follows. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused in the presence of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., *Meth. Enzymol.* 70:419 (1980), and derivative methods thereof. Selected positive clones can be expanded and their monoclonal antibody product harvested for use. Detailed procedures for monoclonal antibody production are described in Davis, L. et al. *Basic Methods in Molecular Biology* Elsevier, New York. Section 21-2.

Polyclonal antiserum containing antibodies to heterogeneous epitopes of a single protein can be prepared by immunizing suitable animals with the expressed protein or peptides derived therefrom described above, which can be unmodified or modified to enhance immunogenicity. Effective polyclonal antibody production is affected by many factors related both to the antigen and the host species. For example, small molecules tend to be less immunogenic than others and can require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis, J. et al. *J. Clin. Endocrinol. Metab.* 33:988-991 (1971).

Booster injections are given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: *Handbook of Experimental Immunology* D. Wier (ed) Blackwell (1973). Plateau concentration of antibody is usually in the range of 0.1 to 0.2 mg/ml of serum (about 12 µM). Affinity of the antisera for the antigen is determined by preparing competitive binding curves, as described, for example, by Fisher, D., Chap. 42 in: *Manual of Clinical Immunology*, 2d Ed. (Rose and Friedman, Eds.) Amer. Soc. For Microbiol., Washington, D.C. (1980). Antibody preparations prepared according to either protocol are useful in quantitative immunoassays that determine concentrations of antigen-bearing substances in biological samples; they are also used semi-quantitatively or qualitatively (e.g., in diagnostic embodiments that identify the presence of HCV in biological samples). The next section describes how some of the novel nucleic acids and peptides described above can be used in diagnostics.

Diagnostic Embodiments

Generally, the embodied diagnostics are classified according to whether a nucleic acid or protein-based assay is used. Some diagnostic assays detect the presence or absence of an embodied HCV nucleic acid sequence in a sample obtained from a patient, whereas, other assays seek to identify whether an embodied HCV peptide is present in a biological sample obtained from a patient. Additionally, the manufacture of kits that incorporate the reagents and methods described herein that allow for the rapid detection and identification of HCV are also embodied. These diagnostic kits can include, for example, an embodied nucleic acid probe or antibody, which specifically detects HCV. The detection component of these kits will typically be supplied in combination with one or more of the following reagents. A support capable of absorbing or otherwise binding DNA, RNA, or protein will often be supplied. Available supports include membranes of nitrocellulose, nylon or derivatized nylon that can be characterized by bearing an array of positively charged substituents. One or more restriction enzymes, control reagents, buffers, amplification enzymes, and non-human polynucleotides like calf-thymus or salmon-sperm DNA can be supplied in these kits.

Useful nucleic acid-based diagnostics include, but are not limited to, direct DNA sequencing, Southern Blot analysis, dot blot analysis, nucleic acid amplification, and combinations of these approaches. The starting point for these analysis is isolated or purified nucleic acid from a biological sample obtained from a patient suspected of contracting HCV or a patient at risk of contracting HCV. The nucleic acid is extracted from the sample and can be amplified by RT-PCR and/or DNA amplification using primers that correspond to regions flanking the embodied HCV nucleic acid sequences (e.g., NS3/4A (SEQ. ID. NO.: 1)).

In some embodiments, nucleic acid probes that specifically hybridize with HCV sequences are attached to a support in an ordered array, wherein the nucleic acid probes are attached to distinct regions of the support that do not overlap with each other. Preferably, such an ordered array is designed to be "addressable" where the distinct locations of the probe are recorded and can be accessed as part of an assay procedure. These probes are joined to a support in different known locations. The knowledge of the precise location of each nucleic acid probe makes these "addressable" arrays particularly useful in binding assays. The nucleic acids from a preparation of several biological samples are then labeled by conventional approaches (e.g., radioactivity or fluorescence) and the labeled samples are applied to the array under conditions that permit hybridization.

If a nucleic acid in the samples hybridizes to a probe on the array, then a signal will be detected at a position on the support that corresponds to the location of the hybrid. Since the identity of each labeled sample is known and the region of the support on which the labeled sample was applied is known, an identification of the presence of the polymorphic variant can be rapidly determined. These approaches are easily automated using technology known to those of skill in the art of high throughput diagnostic or detection analysis.

Additionally, an approach opposite to that presented above can be employed. Nucleic acids present in biological samples can be disposed on a support so as to create an addressable array. Preferably, the samples are disposed on the support at known positions that do not overlap. The presence of HCV nucleic acids in each sample is determined by applying labeled nucleic acid probes that complement nucleic acids, which encode HCV peptides, at locations on the array that correspond to the positions at which the biological samples were disposed. Because the identity of the biological sample and its position on the array is known, the identification of a patient that has been infected with HCV can be rapidly determined. These approaches are also easily automated using technology known to those of skill in the art of high throughput diagnostic analysis.

Any addressable array technology known in the art can be employed. One particular embodiment of polynucleotide arrays is known as Genechips™, and has been generally described in U.S. Pat. No. 5,143,854; PCT publications WO 90/15070 and 92/10092. These arrays are generally produced using mechanical synthesis methods or light directed synthesis methods, which incorporate a combination of photolithographic methods and solid phase oligonucleotide synthesis. (Fodor et al., *Science,* 251:767-777, (1991)). The immobilization of arrays of oligonucleotides on solid supports has been rendered possible by the development of a technology generally identified as "Very Large Scale Immobilized Polymer Synthesis" (VLSPIS™) in which, typically, probes are immobilized in a high density array on a solid surface of a chip. Examples of VLSPIS™ technologies are provided in U.S. Pat. Nos. 5,143,854 and 5,412,087 and in PCT Publications WO 90/15070, WO 92/10092 and WO 95/11995, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and diagnostic information. Examples of such presentation strategies are disclosed in PCT Publications WO 94/12305, WO 94/11530, WO 97/29212, and WO 97/31256.

A wide variety of labels and conjugation techniques are known by those skilled in the art and can be used in various nucleic acid assays. There are several ways to produce labeled nucleic acids for hybridization or PCR including, but not limited to, oligolabeling, nick translation, end-labeling, or PCR amplification using a labeled nucleotide. Alternatively, a nucleic acid encoding an HCV peptide can be cloned into a vector for the production of an mRNA probe. Such vectors are known in the art, are commercially available, and can be used to synthesize RNA probes in vitro by addition of an appropriate RNA polymerase such as T7, T3 or SP6 and labeled nucleotides. A number of companies such as Pharmacia Biotech (Piscataway N.J.), Promega (Madison Wis.), and U.S. Biochemical Corp (Cleveland Ohio) supply commercial kits and protocols for these procedures. Suitable reporter molecules or labels include those radionuclides, enzymes, fluorescent, chemiluminescent, or chromogenic agents, as well as, substrates, cofactors, inhibitors, magnetic particles and the like.

The presence of an HCV peptide in a protein sample obtained from a patient can also be detected by using conventional assays and the embodiments described herein. For example, antibodies that are immunoreactive with the disclosed HCV peptides can be used to screen biological samples for the presence of HCV infection. In preferred embodiments, antibodies that are reactive to the embodied HCV peptides are used to immunoprecipitate the disclosed HCV peptides from biological samples or are used to react with proteins obtained from a biological sample on Western or Immunoblots. Favored diagnostic embodiments also include enzyme-linked immunosorbant assays (ELISA), radioimmunoassays (RIA), immunoradiometric assays (IRMA) and immunoenzymatic assays (IEMA), including sandwich assays using monoclonal and/or polyclonal antibodies specific for the disclosed HCV peptides. Exemplary sandwich assays are described by David et al., in U.S. Pat. Nos. 4,376,110 and 4,486,530. Other embodiments employ aspects of the immune-strip technology disclosed in U.S. Pat. Nos. 5,290,678; 5,604,105; 5,710,008; 5,744,358; and 5,747,274.

In another preferred protein-based diagnostic, the antibodies described herein are attached to a support in an ordered array, wherein a plurality of antibodies are attached to distinct regions of the support that do not overlap with each other. As with the nucleic acid-based arrays, the protein-based arrays are ordered arrays that are designed to be "addressable" such that the distinct locations are recorded and can be accessed as part of an assay procedure. These probes are joined to a support in different known locations. The knowledge of the precise location of each probe makes these "addressable" arrays particularly useful in binding assays. For example, an addressable array can comprise a support having several regions to which are joined a plurality of antibody probes that specifically recognize HCV peptides present in a biological sample and differentiate the isotype of HCV identified herein.

By one approach, proteins are obtained from biological samples and are then labeled by conventional approaches (e.g., radioactivity, calorimetrically, or fluorescently). The labeled samples are then applied to the array under conditions that permit binding. If a protein in the sample binds to an antibody probe on the array, then a signal will be detected at a position on the support that corresponds to the location of the antibody-protein complex. Since the identity of each labeled sample is known and the region of the support on which the labeled sample was applied is known, an identification of the presence, concentration, and/or expression level can be rapidly determined. That is, by employing labeled standards of a known concentration of HCV peptide, an investigator can accurately determine the protein concentration of the particular peptide in a tested sample and can also assess the expression level of the HCV peptide. Conventional methods in densitometry can also be used to more accurately determine the concentration or expression level of the HCV peptide. These approaches are easily automated using technology known to those of skill in the art of high throughput diagnostic analysis.

In another embodiment, an approach opposite to that presented above can be employed. Proteins present in biological samples can be disposed on a support so as to create an addressable array. Preferably, the protein samples are disposed on the support at known positions that do not overlap. The presence of an HCV peptide in each sample is then determined by applying labeled antibody probes that recognize epitopes specific for the HCV peptide. Because the identity of the biological sample and its position on the array is known, an identification of the presence, concentration, and/ or expression level of an HCV peptide can be rapidly determined.

That is, by employing labeled standards of a known concentration of HCV peptide, an investigator can accurately determine the concentration of peptide in a sample and from this information can assess the expression level of the peptide. Conventional methods in densitometry can also be used to more accurately determine the concentration or expression level of the HCV peptide. These approaches are also easily automated using technology known to those of skill in the art of high throughput diagnostic analysis. As detailed above, any addressable array technology known in the art can be employed. The next section describes more compositions that include the HCV nucleic acids and/or HCV peptides described herein.

Compositions Comprising HCV Nucleic Acids or Peptides

Embodiments of the invention also include NS3/4A fusion proteins or nucleic acids encoding these molecules. For instance, production and purification of recombinant protein may be facilitated by the addition of auxiliary amino acids to form a "tag". Such tags include, but are not limited to, His-6, Flag, Myc and GST. The tags may be added to the C-terminus, N-terminus, or within the NS3/4A amino acid sequence. Further embodiments include NS3/4A fusion proteins with amino or carboxy terminal truncations, or internal deletions, or with additional polypeptide sequences added to the amino or carboxy terminal ends, or added internally. Other embodiments include NS3/4A fusion proteins, or truncated or mutated versions thereof, where the residues of the NS3/4A proteolytic cleavage site have been substituted. Such substitutions include, but are not limited to, sequences where the P1' site is a Ser, Gly, or Pro, or the P1 position is an Arg, or where the P8 to P4' sequence is Ser-Ala-Asp-Leu-Glu-Val-Val-Thr-Ser-Thr-Trp-Val (SEQ. ID. NO.: 15).

More embodiments concern an immunogen comprising the NS3/4A fusion protein, or a truncated, mutated, or modified version thereof, capable of eliciting an enhanced immune response against NS3. The immunogen can be provided in a substantially purified form, which means that the immunogen has been rendered substantially free of other proteins, lipids, carbohydrates or other compounds with which it naturally associates.

Some embodiments contain at least one of the HCV nucleic acids or HCV peptides (e.g., SEQ. ID. NOs.: 1-27, 35, 36 or 40-220) joined to a support. Preferably, these supports are manufactured so as to create a multimeric agent. These multimeric agents provide the HCV peptide or nucleic acid in such a form or in such a way that a sufficient affinity to the molecule is achieved. A multimeric agent having an HCV nucleic acid or peptide can be obtained by joining the desired molecule to a macromolecular support. A "support" can be a termed a carrier, a protein, a resin, a cell membrane, a capsid or portion thereof, or any macromolecular structure used to join or immobilize such molecules. Solid supports include, but are not limited to, the walls of wells of a reaction tray, test tubes, polystyrene beads, magnetic beads, nitrocellulose strips, membranes, microparticles such as latex particles, animal cells, Duracyte®, artificial cells, and others. An HCV nucleic acid or peptide can also be joined to inorganic carriers, such as silicon oxide material (e.g., silica gel, zeolite, diatomaceous earth or aminated glass) by, for example, a covalent linkage through a hydroxy, carboxy or amino group and a reactive group on the carrier.

In several multimeric agents, the macromolecular support has a hydrophobic surface that interacts with a portion of the HCV nucleic acid or peptide by a hydrophobic non-covalent interaction. In some cases, the hydrophobic surface of the support is a polymer such as plastic or any other polymer in which hydrophobic groups have been linked such as polystyrene, polyethylene or polyvinyl. Additionally, HCV nucleic acid or peptide can be covalently bound to carriers including proteins and oligo/polysaccharides (e.g. cellulose, starch, glycogen, chitosane or aminated sepharose). In these later multimeric agents, a reactive group on the molecule, such as a hydroxy or an amino group, is used to join to a reactive group on the carrier so as to create the covalent bond. Additional multimeric agents comprise a support that has other reactive groups that are chemically activated so as to attach the HCV nucleic acid or peptide. For example, cyanogen bromide activated matrices, epoxy activated matrices, thio and thiopropyl gels, nitrophenyl chloroformate and N-hydroxy succinimide chlorformate linkages, or oxirane acrylic supports are used. (Sigma).

Carriers for use in the body, (i.e. for prophylactic or therapeutic applications) are desirably physiological, non-toxic and preferably, non-immunoresponsive. Suitable carriers for use in the body include poly-L-lysine, poly-D, L-alanine, liposomes, capsids that display the desired HCV peptide or nucleic acid, and Chromosorb® (Johns-Manville Products, Denver Co.). Ligand conjugated Chromosorb® (Synsorb-Pk) has been tested in humans for the prevention of hemolytic-uremic syndrome and was reported as not presenting adverse reactions. (Armstrong et al. *J. Infectious Diseases* 171:1042-1045 (1995)). For some embodiments, a "naked" carrier (i.e., lacking an attached HCV nucleic acid or peptide) that has the capacity to attach an HCV nucleic acid or peptide in the body of a organism is administered. By this approach, a "prodrug-type" therapy is envisioned in which the naked carrier is administered separately from the HCV nucleic acid or peptide and, once both are in the body of the organism, the carrier and the HCV nucleic acid or peptide are assembled into a multimeric complex.

The insertion of linkers, (e.g., "λ linkers" engineered to resemble the flexible regions of λ phage) of an appropriate length between the HCV nucleic acid or peptide and the support are also contemplated so as to encourage greater flexibility of the HCV peptide, hybrid, or binding partner and thereby overcome any steric hindrance that can be presented by the support. The determination of an appropriate length of linker that allows for an optimal cellular response or lack thereof, can be determined by screening the HCV nucleic acid or peptide with varying linkers in the assays detailed in the present disclosure.

A composite support comprising more than one type of HCV nucleic acid or peptide is also envisioned. A "composite support" can be a carrier, a resin, or any macromolecular structure used to attach or immobilize two or more different HCV nucleic acids or peptides. As above, the insertion of linkers, such as λ linkers, of an appropriate length between the HCV nucleic acid or peptide and the support is also contemplated so as to encourage greater flexibility in the molecule and thereby overcome any steric hindrance that can occur. The determination of an appropriate length of linker that allows for an optimal cellular response or lack thereof, can be determined by screening the HCV nucleic acid or peptide with varying linkers in the assays detailed in the present disclosure.

In other embodiments, the multimeric and composite supports discussed above can have attached multimerized HCV nucleic acids or peptides so as to create a "multimerized-multimeric support" and a "multimerized-composite support", respectively. A multimerized ligand can, for example, be obtained by coupling two or more HCV nucleic acids or peptides in tandem using conventional techniques in molecular biology. The multimerized form of the HCV nucleic acid or peptide can be advantageous for many applications because of the ability to obtain an agent with a higher affinity, for example. The incorporation of linkers or spacers, such as flexible λ linkers, between the individual domains that make-up the multimerized agent can also be advantageous for some embodiments. The insertion of λ linkers of an appropriate length between protein binding domains, for example, can encourage greater flexibility in the molecule and can overcome steric hindrance. Similarly, the insertion of linkers between the multimerized HCV nucleic acid or peptide and the support can encourage greater flexibility and limit steric hindrance presented by the support. The determination of an appropriate length of linker can be determined by screening the HCV nucleic acids or peptides in the assays detailed in this disclosure.

Embodiments also include vaccine compositions and immunogen preparations comprising the NS3/4A fusion protein, or a truncated or mutated version thereof, and, optionally, an adjuvant. The next section describes some of these compositions in greater detail.

Vaccine Compositions and Immunogen Preparations

Vaccine compositions and immunogen preparations comprising, consisting of, or consisting essentially of either an embodied HCV nucleic acid or HCV peptide or both (e.g., any one or more of SEQ. ID. NOs.: 1-27, 35, 36 or 40-220) are contemplated. These compositions typically contain an adjuvant, but do not necessarily require an adjuvant. That is many of the nucleic acids and peptides described herein function as immunogens when administered neat. The compositions described herein (e.g., the HCV immunogens and vaccine compositions containing an adjuvant, such as ribavirin) can be manufactured in accordance with conventional methods of galenic pharmacy to produce medicinal agents for administration to animals, e.g., mammals including humans.

Various nucleic acid-based vaccines are known and it is contemplated that these compositions and approaches to immunotherapy can be augmented by reformulation with ribavirin (See e.g., U.S. Pat. Nos. 5,589,466 and 6,235,888). By one approach, for example, a gene encoding one of the HCV peptides described herein (e.g., SEQ. ID. NO.: 1 or SEQ. ID. NO.: 35), or a nucleic acid encoding any one of SEQ ID NOs.: 40-220 is cloned into an expression vector capable of expressing the polypeptide when introduced into a subject. The expression construct is introduced into the subject in a mixture of adjuvant (e.g., ribavirin) or in conjunction with an adjuvant (e.g., ribavirin). For example, the adjuvant (e.g., ribavirin) is administered shortly after the expression construct at the same site. Alternatively, RNA encoding the HCV polypeptide antigen of interest is provided to the subject in a mixture with ribavirin or in conjunction with an adjuvant (e.g., ribavirin).

Where the antigen is to be DNA (e.g., preparation of a DNA vaccine composition), suitable promoters include Simian Virus 40 (SV40), Mouse Mammary Tumor Virus (MMTV) promoter, Human Immunodeficiency Virus (HIV) such as the HIV Long Terminal Repeat (LTR) promoter, Moloney virus, ALV, Cytomegalovirus (CMV) such as the CMV immediate early promoter, Epstein Barr Virus (EBV), Rous Sarcoma Virus (RSV) as well as promoters from human genes such as human actin, human myosin, human hemoglobin, human muscle creatine and human metalothionein can be used. Examples of polyadenylation signals useful with some embodiments, especially in the production of a genetic vaccine for humans, include but are not limited to, SV40 polyadenylation signals and LTR polyadenylation signals. In particular, the SV40 polyadenylation signal, which is in pCEP4 plasmid (Invitrogen, San Diego Calif.), referred to as the SV40 polyadenylation signal, is used.

In addition to the regulatory elements required for gene expression, other elements may also be included in a gene construct. Such additional elements include enhancers. The enhancer may be selected from the group including but not limited to: human actin, human myosin, human hemoglobin, human muscle creatine and viral enhancers such as those from CMV, RSV and EBV. Gene constructs can be provided with mammalian origin of replication in order to maintain the construct extrachromosomally and produce multiple copies of the construct in the cell. Plasmids pCEP4 and pREP4 from Invitrogen (San Diego, Calif.) contain the Epstein Barr virus origin of replication and nuclear antigen EBNA-1 coding region, which produces high copy episomal replication without integration. All forms of DNA, whether replicating or non-replicating, which do not become integrated into the genome, and which are expressible, can be used. Preferably, the genetic vaccines comprise ribavirin and a nucleic acid encoding NS3/4A, NS3, or a fragment or mutant thereof (SEQ. ID. NOs.: 2-26 and 36). The following example describes the preparation of a genetic vaccine suitable for use in humans.

Example 9

An HCV expression plasmid is designed to express the NS3/4A peptide (SEQ. ID. NO.: 2 or SEQ. ID. NO.: 36). The NS3/4A coding sequence of NS3/4A-pVAX or MSLF1-pVAX is removed enzymatically, and the isolated fragment is inserted into plasmid A so that it is under the transcriptional control of the CMV promoter and the RSV enhancer element. (See U.S. Pat. No. 6,235,888 to Pachuk, et al.). Plasmid backbone A is 3969 base pairs in length; it contains a PBR origin of replication for replicating in *E. coli* and a kanamycin resistance gene. Inserts such as the NS3/4A or codon-optimized NS3/4A, are cloned into a polylinker region, which places the insert between and operably linked to the promoter and polyadenylation signal. Transcription of the cloned inserts is under the control of the CMV promoter and the RSV enhancer elements. A polyadenylation signal is provided by the presence of an SV40 poly A signal situated just 3' of the cloning site. An NS3/4A containing vaccine composition or immunogen preparation is then made by mixing any amount of construct between about 0.5-500 mg, for example, between 0.5-1 µg, 1-2 µg, 2-5 µg, 5-10 µg, 10-20 µg, 20-50 µg, 50-75 µg, 75-100 µg, 100-250 µg, 250 µg-500 µg with any amount of ribavirin between about 0.1-10 mg, for example, between 0.1 mg-0.5 mg, 0.5 mg-1 mg, 1 mg-2 mg, 2 mg-5 mg, or 5 mg-10 mg of ribavirin.

Said vaccine composition can be used to raise antibodies in a mammal (e.g., mice or rabbits) or can be injected intramuscularly into a human so as to raise antibodies, preferably a human that is chronically infected with the HCV virus. The recipient preferably receives three immunization boosts of the mixture at 4-week intervals, as well. By the third boost, the titer of antibody specific for HCV will be significantly increased. Additionally, at this time, said subject will experience an enhanced antibody and T-cell mediated immune response against NS3, as evidenced by an increased fraction of NS3 specific antibodies as detected by EIA, and a reduction in viral load as detected by RT-PCR.

Also contemplated are vaccine compositions comprising one or more of the HCV peptides described herein. Preferably, the embodied peptide vaccines comprise ribavirin and NS3/4A, NS3, or a fragment or mutant thereof (e.g., SEQ. ID. NOs.: 2-26, 36, and 40-220). The following example describes an approach to prepare a vaccine composition comprising an NS3/4A fusion protein and an adjuvant.

Example 10

To generate a tagged NS3/4A construct, the NS3/4A coding sequence of NS3/4A-pVAX or MSLF1-pVAX is removed enzymatically, and the isolated fragment is inserted into an Xpress vector (Invitrogen). The Xpress vector allows for the production of a recombinant fusion protein having a short N-terminal leader peptide that has a high affinity for divalent cations. Using a nickel-chelating resin (Invitrogen), the recombinant protein can be purified in one step and the leader can be subsequently removed by cleavage with enterokinase. A preferred vector is the pBlueBacHis2 Xpress. The pBlueBacHis2 Xpress vector is a Baculovirus expression vector containing a multiple cloning site, an ampicillin resistance gene, and a lac z gene. Accordingly, the digested amplification fragment is cloned into the pBlueBacHis2 Xpress vector and SF9 cells are infected. The expression protein is then isolated or purified according to the manufacturer's instructions. An NS3/4A containing vaccine composition is then made by mixing any amount of the rNS3/4A between about 0.1-500 mg, for example, 1-5 µg, 5-10 µg, 10-20 µg, 20-30 µg, 30-50 µg, 50-100 µg, 100-250 µg, or 250-500 µg with any amount of ribavirin between about 0.1-10 mg, for example, between 0.1 mg-0.5 mg, 0.5 mg-1 mg, 1 mg-2 mg, 2 mg-5 mg, or 5 mg-10 mg of ribavirin.

Said vaccine composition can be used to raise antibodies in a mammal (e.g., mice or rabbits) or can be injected intramuscularly into a human so as to raise antibodies, preferably a human that is chronically infected with the HCV virus. The recipient preferably receives three immunization boosts of the mixture at 4-week intervals. By the third boost, the titer of antibody specific for HCV will be significantly increased. Additionally, at this time, said subject will experience an enhanced antibody and T-cell mediated immune response against NS3, as evidenced by an increased fraction of NS3 specific antibodies as detected by EIA, and a reduction in viral load as detected by RT-PCR.

The compositions that comprise one or more of the embodied HCV nucleic acids or peptides may contain other ingredients including, but not limited to, adjuvants, binding agents, excipients such as stabilizers (to promote long term storage), emulsifiers, thickening agents, salts, preservatives, solvents, dispersion media, coatings, antibacterial and antifungal agents, isotonic and absorption delaying agents and the like. These compositions are suitable for treatment of animals either as a preventive measure to avoid a disease or condition or as a therapeutic to treat animals already afflicted with a disease or condition.

Many other ingredients can be also be present. For example, the adjuvant and antigen can be employed in admixture with conventional excipients (e.g., pharmaceutically acceptable organic or inorganic carrier substances suitable for parenteral, enteral (e.g., oral) or topical application that do not deleteriously react with the adjuvent and/or antigen). Suitable pharmaceutically acceptable carriers include, but are not limited to, water, salt solutions, alcohols, gum arabic, vegetable oils, benzyl alcohols, polyetylene glycols, gelatine, carbohydrates such as lactose, amylose or starch, magnesium stearate, talc, silicic acid, viscous paraffin, perfume oil, fatty acid monoglycerides and diglycerides, pentaerythritol fatty acid esters, hydroxy methylcellulose, polyvinyl pyrrolidone, etc. Many more suitable carriers are described in *Remington's Pharmaceutical Sciences*, 15th Edition, Easton:Mack Publishing Company, pages 1405-1412 and 1461-1487 (1975) and The National *Formulary* XIV, 14th Edition, Washington, American Pharmaceutical Association (1975).

The gene constructs described herein, in particular, may be formulated with or administered in conjunction with agents that increase uptake and/or expression of the gene construct by the cells relative to uptake and/or expression of the gene construct by the cells that occurs when the identical genetic vaccine is administered in the absence of such agents. Such agents and the protocols for administering them in conjunction with gene constructs are described in PCT Patent Application Serial Number PCT/US94/00899 filed Jan. 26, 1994. Examples of such agents include: $CaPO_4$, DEAE dextran, anionic lipids; extracellular matrix-active enzymes; saponins; lectins; estrogenic compounds and steroidal hormones; hydroxylated lower alkyls; dimethyl sulfoxide (DMSO); urea; and benzoic acid esters anilides, amidines, urethanes and the hydrochloride salts thereof such as those of the family of local anesthetics. In addition, the gene constructs are encapsulated within/administered in conjunction with lipids/polycationic complexes.

The compositions described herein can be sterilized and if desired mixed with auxiliary agents, e.g., lubricants, preservatives, stabilizers, wetting agents, emulsifiers, salts for influencing osmotic pressure, buffers, coloring, flavoring and/or aromatic substances and the like that do not deleteriously react with the adjuvant or the antigen.

The effective dose and method of administration of a particular formulation can vary based on the individual patient and the type and stage of the disease, as well as other factors known to those of skill in the art. Therapeutic efficacy and toxicity of the vaccines can be determined by standard pharmaceutical procedures in cell cultures or experimental animals, e.g., $ED_{50}$ (the dose therapeutically effective in 50% of the population). The data obtained from cell culture assays and animal studies can be used to formulate a range of dosage for human use. The dosage of the vaccines lies preferably within a range of circulating concentrations that include the $ED_{50}$ with no toxicity. The dosage varies within this range depending upon the type of adjuvant derivative and HCV antigen, the dosage form employed, the sensitivity of the patient, and the route of administration.

Since many adjuvants, including ribavirin, has been on the market for several years, many dosage forms and routes of administration are known. All known dosage forms and routes of administration can be provided within the context of the embodiments described herein. Preferably, an amount of adjuvant that is effective to enhance an immune response to an antigen in an animal can be considered to be an any amount that is sufficient to achieve a blood serum level of antigen approximately 0.25-12.5 μg/ml in the animal, preferably, about 2.5 μg/ml. In some embodiments, the amount of adjuvant is determined according to the body weight of the animal to be given the vaccine. Accordingly, the amount of adjuvant in a particular formulation can be any amount between about 0.1-6.0 mg/kg body weight. That is, some embodiments have an amount of adjuvant that corresponds to any amount between 0.1-1.0 mg/kg, 1.1-2.0 mg/kg, 2.1-3.0 mg/kg, 3.1-4.0 mg/kg, 4.1-5.0 mg/kg, 5.1, and 6.0 mg/kg body weight of an animal. More conventionally, some of the compositions described herein contain any amount between about 0.25 mg-2000 mg of adjuvant. That is, some embodiments have approximately 250 μg, 500 μg, 1 mg, 25 mg, 50 mg, 100 mg, 150 mg, 200 mg, 250 mg, 300 mg, 350 mg, 400 mg, 450 mg, 500 mg, 550 mg, 600 mg, 650 mg, 700 mg, 750 mg, 800 mg, 850 mg, 900 mg, 1 g, 1.1 g, 1.2 g, 1.3 g, 1.4 g, 1.5 g, 1.6 g, 1.7 g, 1.8 g, 1.9 g, and 2 g of adjuvant.

As one of skill in the art will appreciate, the amount of antigens in a vaccine or immunogen preparation can vary depending on the type of antigen and its immunogenicity. The amount of antigens in the vaccines can vary accordingly. Nevertheless, as a general guide, the compositions described herein can have any amount between approximately 0.25-2000 mg of an HCV antigen discussed herein. For example, the amount of antigen can be between about 0.25 mg-5 mg, 5-10 mg, 10-100 mg, 100-500 mg, and upwards of 2000 mg. Preferably, the amount of HCV antigen is 0.1 μg-1 mg, desirably, 1 μg-100 μg, preferably 5 μg-50 μg, and, most preferably, 7 μg, 8 μg, 9 μg, 10 μg, 11 μg-20 μg, when said antigen is a nucleic acid and 1 μg-100 mg, desirably, 10 μg-10 mg, preferably, 100 μg-1 mg, and, most preferably, 200 μg, 300 μg, 400 μg, 500 μg, 600 μg, or 700 μg-1 mg, when said antigen is a peptide.

In some approaches described herein, the exact amount of adjuvant and/or HCV antigen is chosen by the individual physician in view of the patient to be treated. Further, the amounts of adjuvant can be added in combination to or separately from the same or equivalent amount of antigen and these amounts can be adjusted during a particular vaccination protocol so as to provide sufficient levels in light of patient-specific or antigen-specific considerations. In this vein, patient-specific and antigen-specific factors that can be taken into account include, but are not limited to, the severity of the disease state of the patient, age, and weight of the patient, diet, time and frequency of administration, drug combination(s), reaction sensitivities, and tolerance/response to therapy. The next section describes the use of ribavirin as an adjuvant in greater detail.

Ribavirin

Nucleoside analogs have been widely used in anti-viral therapies due to their capacity to reduce viral replication. (Hosoya et al., *J. Inf. Dis.*, 168:641-646 (1993)). ribavirin (1-β-D-ribofuranosyl-1,2,4-triazole-3-carboxamide) is a synthetic guanosine analog that has been used to inhibit RNA and DNA virus replication. (Huffman et al., *Antimicrob. Agents. Chemother.*, 3:235 (1973); Sidwell et al., *Science*, 177:705 (1972)). Ribavirin has been shown to be a competitive inhibitor of inositol mono-phosphate (IMP) dehydrogenase (IMPDH), which converts IMP to IMX (which is then converted to GMP). De Clercq, Anti viral Agents: characteristic activity spectrum depending on the molecular target with which they interact, Academic press, Inc., New York N.Y., pp. 1-55 (1993). Intracellular pools of GTP become depleted as a result of long term ribavirin treatment.

In addition to antiviral activity, investigators have observed that some guanosine analogs have an effect on the immune system. (U.S. Pat. Nos. 6,063,772 and 4,950,647). Ribavirin has been shown to inhibit functional humoral immune responses (Peavy et al., *J. Immunol.*, 126:861-864 (1981); Powers et al., *Antimicrob. Agents. Chemother.*, 22:108-114 (1982)) and IgE-mediated modulation of mast cell secretion. (Marquardt et al., *J. Pharmacol. Exp. Therapeutics*, 240:145-149 (1987)). Some investigators report that a daily oral therapy of ribavirin has an immune modulating effect on humans and mice. (Hultgren et al., *J. Gen. Virol.*, 79:2381-2391 (1998) and Cramp et al., *Gastron. Enterol.*, 118:346-355 (2000)). Nevertheless, the current understanding of the effects of ribavirin on the immune system is in its infancy. As disclosed below, ribavirin was found to be a potent adjuvant.

Example 11

In a first set of experiments, groups of three to five Balb/c mice (BK Universal, Uppsala, Sweden) were immunized i.p or s.c. (e.g., at the base of the tail) with 10 μg or 100 μg of recombinant hepatitis C virus non-structural 3 (rNS3) protein. The rNS3 was dissolved in phosphate buffered saline (PBS) alone or PBS containing 1 mg ribavirin (obtained from ICN, Costa Mesa, Calif.). Mice were injected with a total volume of 100 μl per injection.

At two and four weeks following i.p. immunization, all mice were bled by retro-orbital sampling. Serum samples were collected and analyzed for the presence of antibodies to rNS3. To determine the antibody titer, an enzyme immunoassay (EIA) was performed. (See e.g., Hultgren et al., *J Gen Virol.* 79:2381-91 (1998) and Hultgren et al., *Clin. Diagn. Lab. Immunol.* 4:630-632 (1997)). The antibody levels were recorded as the highest serum dilution giving an optical density at 405 nm more than twice that of non-immunized mice.

Figure 7:
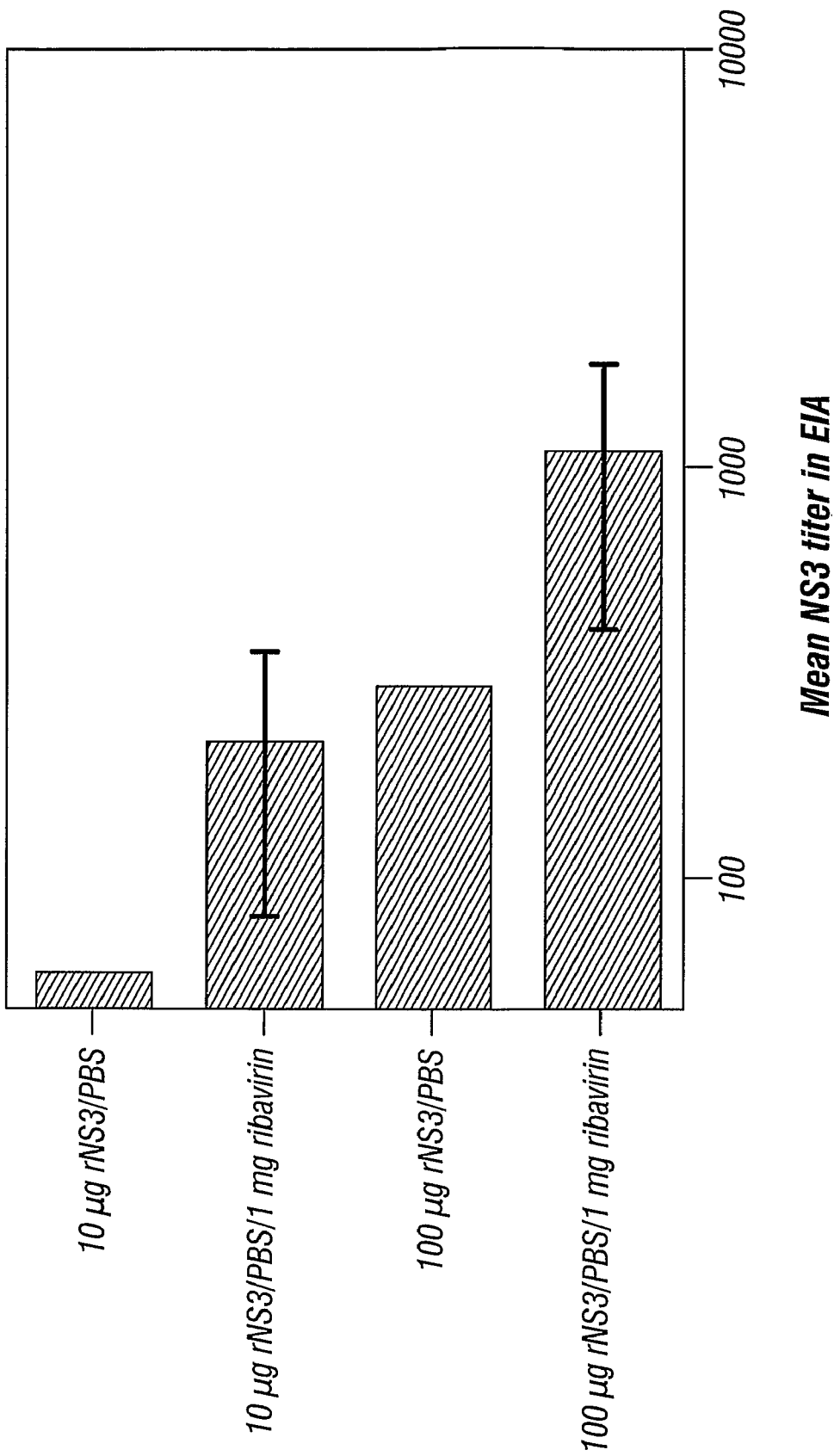

Mice that received 10 μg or 100 μg rNS3 mixed with 1 mg ribavirin in PBS displayed consistently higher levels of NS3 antibodies. The antibody titer that was detected by EIA at two weeks post-immunization is shown in FIG. 7. The vaccine formulations having 1 mg of ribavirin and either 10 μg or 100 μg of rNS3 induced a significantly greater antibody titer than the vaccine formulations composed of only rNS3.

In a second set of experiments, groups of eight Balb/c mice were immunized intraperitoneally with 10 or 50 μg of rNS3 in 100 μl phosphate buffered saline containing either 0 mg, 1 mg, 3 mg, or 10 mg ribavirin (Sigma). At four, six and eight weeks the mice were bled and serum was separated and frozen. After completion of the study, sera were tested for the levels of antibodies to recombinant NS3, as described above. Mean antibody levels to rNS3 were compared between the groups using Student's t-test (parametric analysis) or Mann-Whitney (non-parametric analysis) and the software package StatView 4.5 (Abacus Concepts, Berkely, Calif.). The adjuvant effect of ribavirin when added in three doses to 10 μg of rNS3 are provided in TABLE 11. The adjuvant effect of ribavirin when added in three doses to 50 μg of rNS3 are provided in TABLE 11. Parametrical comparison of the mean rNS3 antibody titres in mice receiving different 10 μg or 50 μg of rNS3 and different doses of ribavirin are provided in TABLES 12 and 13, respectively. Non-parametrical comparison of mean NS3 antibody titres in mice receiving different 10 μg or 50 μg of rNS3 and different doses of ribavirin are provided in TABLES 14-16, respectively. The values given represent end point titres to recombinant rNS3.

TABLE 11

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| None | 10 | 5:1 | 300 | 1500 | 1500 |
| None | 10 | 5:2 | <60 | 7500 | 1500 |
| None | 10 | 5:3 | <60 | 1500 | 300 |
| None | 10 | 5:4 | 60 | 1500 | 1500 |
| None | 10 | 5:5 | <60 | 1500 | nt |
| None | 10 | 5:6 | 60 | 1500 | 1500 |
| None | 10 | 5:7 | <60 | 7500 | 7500 |
| None | 10 | 5:8 | 300 | 37500 | 7500 |
| Group mean titre (mean ± SD) | | | 180 ± 139 | 7500 ± 12421 | 3042 ± 3076 |
| 1 | 10 | 6:1 | 300 | 37500 | 37500 |
| 1 | 10 | 6:2 | <60 | 1500 | 1500 |
| 1 | 10 | 6:3 | 300 | 37500 | 187500 |
| 1 | 10 | 6:4 | 300 | 37500 | 7500 |
| 1 | 10 | 6:5 | 60 | nt | nt |
| 1 | 10 | 6:6 | <60 | 37500 | 7500 |
| 1 | 10 | 6:7 | <60 | 37500 | 7500 |
| 1 | 10 | 6:8 | 300 | 7500 | 7500 |
| Group mean titre (mean ± SD) | | | 252 ± 107 | 28071 ± 16195 | 36642 ± 67565 |
| 3 | 10 | 7:1 | 60 | 37500 | 7500 |
| 3 | 10 | 7:2 | 60 | 37500 | 37500 |
| 3 | 10 | 7:3 | 300 | 7500 | 7500 |
| 3 | 10 | 7:4 | 300 | 37500 | 7500 |
| 3 | 10 | 7:5 | 300 | 37500 | 37500 |
| 3 | 10 | 7:6 | 300 | 37500 | 37500 |
| 3 | 10 | 7:7 | 60 | 7500 | 7500 |
| 3 | 10 | 7:8 | 60 | 37500 | 37500 |
| Group mean titre (mean ± SD) | | | 180 ± 128 | 30000 ± 13887 | 22500 ± 34637 |
| 10 | 10 | 8:1 | 300 | 37500 | 37500 |
| 10 | 10 | 8:2 | 300 | 37500 | 37500 |
| 10 | 10 | 8:3 | <60 | 300 | 300 |
| 10 | 10 | 8:4 | 60 | 7500 | 7500 |
| 10 | 10 | 8:5 | <60 | 300 | 300 |
| 10 | 10 | 8:6 | <60 | 37500 | 37500 |
| 10 | 10 | 8:7 | <60 | 7500 | 7500 |
| 10 | 10 | 8:8 | <60 | nt | nt |
| Group mean titre (mean ± SD) | | | 220 ± 139 | 18300 ± 18199 | 18300 ± 18199 |

TABLE 12

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| None | 50 | 1:1 | 60 | 7500 | 7500 |
| None | 50 | 1:2 | 60 | 7500 | 7500 |
| None | 50 | 1:3 | 60 | 7500 | 7500 |
| None | 50 | 1:4 | <60 | 1500 | 300 |
| None | 50 | 1:5 | 300 | 37500 | 37500 |
| None | 50 | 1:6 | 60 | 7500 | 7500 |
| None | 50 | 1:7 | 60 | 37500 | 7500 |
| None | 50 | 1:8 | . | . | . |

TABLE 12-continued

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| Group mean titre (mean ± SD) | | | 100 ± 98 | 15214 ± 15380 | 10757 ± 12094 |
| 1 | 50 | 2:1 | 60 | 7500 | 7500 |
| 1 | 50 | 2:2 | 300 | 37500 | 7500 |
| 1 | 50 | 2:3 | 60 | 187500 | 7500 |
| 1 | 50 | 2:4 | 60 | 37500 | 187500 |
| 1 | 50 | 2:5 | 60 | 37500 | 7500 |
| 1 | 50 | 2:6 | 60 | 37500 | 37500 |
| 1 | 50 | 2:7 | 300 | 37500 | 7500 |
| 1 | 50 | 2:8 | 300 | 37500 | 37500 |
| Group mean titre (mean ± SD) | | | 150 ± 124 | 52500 ± 55549 | 37500 ± 62105 |
| 3 | 50 | 3:1 | 60 | 37500 | 7500 |
| 3 | 50 | 3:2 | 300 | 37500 | 37500 |
| 3 | 50 | 3:3 | 300 | 37500 | 7500 |
| 3 | 50 | 3:4 | 60 | 37500 | 7500 |
| 3 | 50 | 3:5 | 300 | 37500 | 7500 |
| 3 | 50 | 3:6 | 60 | 37500 | 7500 |
| 3 | 50 | 3:7 | — | 7500 | 37500 |
| 3 | 50 | 3:8 | 1500 | 7500 | 37500 |
| Group mean titre (mean ± SD) | | | 387 ± 513 | 30000 ± 13887 | 18750 ± 15526 |
| 10 | 50 | 4:1 | 300 | 7500 | 7500 |
| 10 | 50 | 4:2 | 300 | 37500 | 37500 |
| 10 | 50 | 4:3 | 60 | 7500 | 7500 |
| 10 | 50 | 4:4 | 60 | 7500 | 7500 |
| 10 | 50 | 4:5 | 60 | 1500 | 1500 |
| 10 | 50 | 4:6 | 60 | 7500 | 37500 |
| 10 | 50 | 4:7 | — | 7500 | 7500 |
| 10 | 50 | 8:8 | 60 | 37500 | 7500 |
| Group mean titre (mean ± SD) | | | 140 ± 124 | 10929 ± 11928 | 15214 ± 15380 |

TABLE 13

| Group | Week | Mean ± SD | Group | Mean ± SD | analysis | p-value |
|---|---|---|---|---|---|---|
| 10 μg NS3/no ribavirin | 4 | 180 ± 139 | 10 μg NS3/ 1 mg ribavirin | 252 ± 107 | Students t-test | 0.4071 |
| | 6 | 7500 ± 12421 | | 28071 ± 16195 | Students t-test | 0.0156* |
| | 8 | 3042 ± 3076 | | 36642 ± 67565 | Students t-test | 0.2133 |
| 10 μg NS3/no ribavirin | 4 | 180 ± 139 | 10 μg NS3/ 3 mg ribavirin | 180 ± 128 | Students t-test | 1.000 |
| | 6 | 7500 ± 12421 | | 30000 ± 13887 | Students t-test | 0.0042** |
| | 8 | 3042 ± 3076 | | 22500 ± 34637 | Students t-test | 0.0077** |
| 10 μg NS3/no ribavirin | 4 | 180 ± 139 | 10 μg NS3/ 10 mg ribavirin | 220 ± 139 | Students t-test | 0.7210 |
| | 6 | 7500 ± 12421 | | 18300 ± 18199 | Students t-test | 0.1974 |
| | 8 | 3042 ± 3076 | | 18300 ± 18199 | Students t-test | 0.0493* |

TABLE 14

| Group | Week | Mean ± SD | Group | Mean ± SD | analysis | p-value |
|---|---|---|---|---|---|---|
| 50 μg NS3/no ribavirin | 4 | 100 ± 98 | 50 μg NS3/ 1 mg ribavirin | 150 ± 124 | Students t-test | 0.4326 |
| | 6 | 15214 ± 15380 | | 52500 ± 55549 | Students t-test | 0.1106 |
| | 8 | 10757 ± 12094 | | 37500 ± 62105 | Students t-test | 0.2847 |
| 50 μg NS3/no ribavirin | 4 | 100 ± 98 | 50 μg NS3/ 3 mg ribavirin | 387 ± 513 | Students t-test | 0.2355 |
| | 6 | 15214 ± 15380 | | 30000 ± 13887 | Students t-test | 0.0721 |

TABLE 14-continued

| Group | Week | Mean ± SD | Group | Mean ± SD | analysis | p-value |
|---|---|---|---|---|---|---|
| | 8 | 10757 ± 12094 | | 18750 ± 15526 | Students t-test | 0.2915 |
| 50 µg NS3/no ribavirin | 4 | 100 ± 98 | 50 µg NS3/ 10 mg ribavirin | 140 ± 124 | Students t-test | 0.5490 |
| | 6 | 15214 ± 15380 | | 10929 ± 11928 | Students t-test | 0.5710 |
| | 8 | 10757 ± 12094 | | 15214 ± 15380 | Students t-test | 0.5579 |

Significance levels: NS = not significant;
*= p < 0.05;
**= p < 0.01;
***= p < 0.001

TABLE 15

| Group | Week | Mean ± SD | Group | Mean ± SD | analysis | p-value |
|---|---|---|---|---|---|---|
| 10 µg NS3/no ribavirin | 4 | 180 ± 139 | 10 µg NS3/ 1 mg ribavirin | 252 ± 107 | Mann-Whitney | 0.4280 |
| | 6 | 7500 ± 12421 | | 28071 ± 16195 | Mann-Whitney | 0.0253* |
| | 8 | 3042 ± 3076 | | 36642 ± 67565 | Mann-Whitney | 0.0245* |
| 10 µg NS3/no ribavirin | 4 | 180 ± 139 | 10 µg NS3/ 3 mg ribavirin | 180 ± 128 | Mann-Whitney | 0.0736 |
| | 6 | 7500 ± 12421 | | 30000 ± 13887 | Mann-Whitney | 0.0050** |
| | 8 | 3042 ± 3076 | | 22500 ± 34637 | Mann-Whitney | 0.0034** |
| 10 µg NS3/no ribavirin | 4 | 180 ± 139 | 10 µg NS3/ 10 mg ribavirin | 220 ± 139 | Mann-Whitney | 0.8986 |
| | 6 | 7500 ± 12421 | | 18300 ± 18199 | Mann-Whitney | 0.4346 |
| | 8 | 3042 ± 3076 | | 18300 ± 18199 | Mann-Whitney | 0.2102 |

TABLE 16

| Group | Week | Mean ± SD | Group | Mean ± SD | analysis | p-value |
|---|---|---|---|---|---|---|
| 50 µg NS3/no ribavirin | 4 | 100 ± 98 | 50 µg NS3/ 1 mg ribavirin | 150 ± 124 | Mann-Whitney | 0.1128 |
| | 6 | 15214 ± 15380 | | 52500 ± 55549 | Mann-Whitney | 0.0210* |
| | 8 | 10757 ± 12094 | | 37500 ± 62105 | Mann-Whitney | 0.1883 |
| 50 µg NS3/no ribavirin | 4 | 100 ± 98 | 50 µg NS3/ 3 mg ribavirin | 387 ± 513 | Mann-Whitney | 0.1400 |
| | 6 | 15214 ± 15380 | | 30000 ± 13887 | Mann-Whitney | 0.0679 |
| | 8 | 10757 ± 12094 | | 18750 ± 15526 | Mann-Whitney | 0.2091 |
| 50 µg NS3/no ribavirin | 4 | 100 ± 98 | 50 µg NS3/ 10 mg ribavirin | 140 ± 124 | Mann-Whitney | 0.4292 |
| | 6 | 15214 ± 15380 | | 10929 ± 11928 | Mann-Whitney | 0.9473 |
| | 8 | 10757 ± 12094 | | 15214 ± 15380 | Mann-Whitney | 0.6279 |

Significance levels: NS = not significant;
*= p < 0.05;
**= p < 0.01;
***= p < 0.001

X.

The data above demonstrates that ribavirin facilitates or enhances an immune response to an HCV antigen or HCV epitopes. A potent immune response to rNS3 was elicited after immunization with a vaccine composition comprising as little as 1 mg ribavirin and 10 μg of rNS3 antigen. The data above also provide evidence that the amount of ribavirin that is sufficient to facilitate an immune response to an antigen is between 1 and 3 mg per injection for a 25-30 g Balb/c mouse. It should be realized, however, that these amounts are intended for guidance only and should not be interpreted to limit the scope of the invention in any way. Nevertheless, the data shows that vaccine compositions comprising approximately 1 to 3 mg doses of ribavirin induce an immune response that is more than 12 times higher than the immune response elicited in the absence of without ribavirin. Thus, ribavirin has a significant adjuvant effect on the humoral immune response of an animal and thereby, enhances or facilitates the immune response to the antigen. The example below describes experiments that were performed to better understand the amount of ribavirin needed to enhance or facilitate an immune response to an antigen.

Example 12

Figure 8:
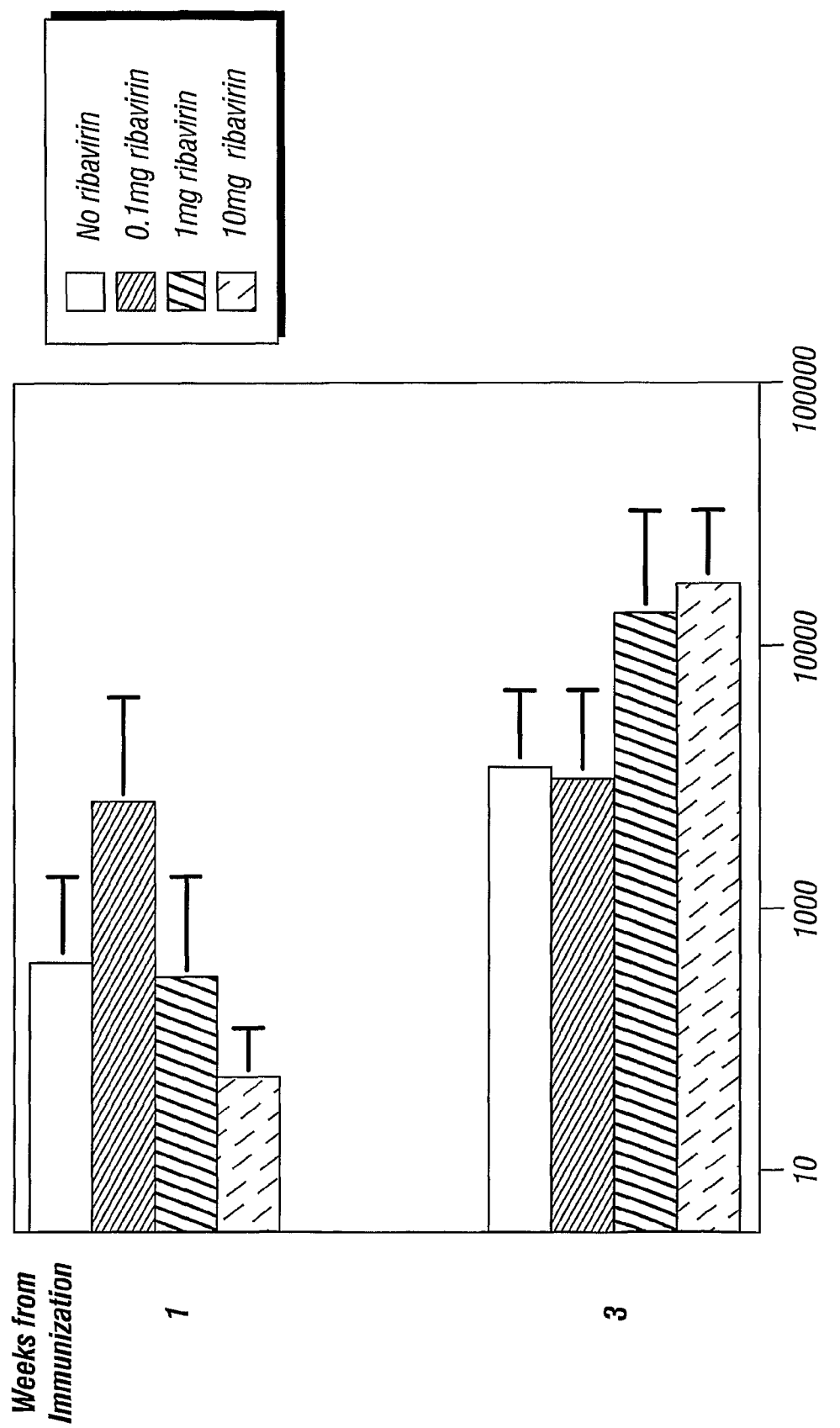

To determine a dose of ribavirin that is sufficient to provide an adjuvant effect, the following experiments were performed. In a first set of experiments, groups of mice (three per group) were immunized with a 20 μg rNS3 alone or a mixture of 20 μg rNS3 and 0.1 mg, 1 mg, or 10 mg ribavirin. The levels of antibody to the antigen were then determined by EIA. The mean endpoint titers at weeks 1 and 3 were plotted and are shown in FIG. 8. It was discovered that the adjuvant effect provided by ribavirin had different kinetics depending on the dose of ribavirin provided. For example, even low doses (<1 mg) of ribavirin were found to enhance antibody levels at week one but not at week three, whereas, higher doses (1-10 mg) were found to enhance antibody levels at week three.

A second set of experiments was also performed. In these experiments, groups of mice were injected with vaccine compositions comprising various amounts of ribavirin and rNS3 and the IgG response in these animals was monitored. The vaccine compositions comprised approximately 100 μl phosphate buffered saline and 20 μg rNS3 with or without 0.1 mg, 1.0 mg, or 10 mg ribavirin (Sigma). The mice were bled at week six and rNS3-specific IgG levels were determined by EIA as described previously. As shown in TABLE 17, the adjuvant effects on the sustained antibody levels were most obvious in the dose range of 1 to 10 mg per injection for a 25-30 g mouse.

TABLE 17

| Immunogen | Amount (mg) ribavirin mixed with the immunogen | Mouse ID | Endpoint titre of rNS3 IgG at indicated week | | |
|---|---|---|---|---|---|
| | | | Week 1 | Week 2 | Week 3 |
| 20 μg rNS3 | None | 1 | 60 | 360 | 360 |
| 20 μg rNS3 | None | 2 | 360 | 360 | 2160 |
| 20 μg rNS3 | None | 3 | 360 | 2160 | 2160 |
| | | Mean | 260 ± 173 | 960 ± 1039 | 1560 ± 1039 |
| 20 μg rNS3 | 0.1 | 4 | 2160 | 12960 | 2160 |
| 20 μg rNS3 | 0.1 | 5 | 60 | 60 | 60 |
| 20 μg rNS3 | 0.1 | 6 | <60 | 2160 | 2160 |
| | | | 1110 ± 1484 | 5060 ± 6921 | 1460 ± 1212 |
| 20 μg rNS3 | 1.0 | 7 | <60 | 60 | 12960 |
| 20 μg rNS3 | 1.0 | 8 | <60 | 2160 | 2160 |
| 20 μg rNS3 | 1.0 | 9 | 360 | 2160 | 2160 |
| | | Mean | 360 | 1460 ± 1212 | 5760 ± 6235 |
| 20 μg rNS3 | 10.0 | 10 | 360 | 12960 | 77760 |
| 20 μg rNS3 | 10.0 | 11 | <60 | 2160 | 12960 |
| 20 μg rNS3 | 10.0 | 12 | 360 | 2160 | 2160 |
| | | Mean | 360 | 5760 ± 6235 | 30960 ± 40888 |

In a third set of experiments, the adjuvant effect of ribavirin after primary and booster injections was investigated. In these experiments, mice were given two intraperitoneal injections of a vaccine composition comprising 10 μg rNS3 with or without ribavirin and the IgG subclass responses to the antigen was monitored, as before. Accordingly, mice were immunized with 100 μl phosphate buffered containing 10 μg recombinant NS3 alone, with or without 0.1 or 1.0 mg ribavirin (Sigma) at weeks 0 and 4. The mice were bled at week six and NS3-specific IgG subclasses were determined by EIA as described previously. As shown in TABLE 18, the addition of ribavirin to the immunogen prior to the injection does not change the IgG subclass response in the NS3-specific immune response. Thus, the adjuvant effect of a vaccine composition comprising ribavirin and an antigen can not be explained by a shift in of the Th1/Th2-balance. It appears that another mechanism may be responsible for the adjuvant effect of ribavirin.

TABLE 18

| Immunogen | Amount (mg) ribavirin mixed with the immunogen | Mouse ID | Endpoint titre of indicated NS3 IgG subclass | | | |
|---|---|---|---|---|---|---|
| | | | IgG1 | IgG2a | IgG2b | IgG3 |
| 10 μg rNS3 | None | 1 | 360 | 60 | <60 | 60 |
| 10 μg rNS3 | None | 2 | 360 | <60 | <60 | 60 |
| 10 μg rNS3 | None | 3 | 2160 | 60 | <60 | 360 |
| | | Mean | 960 ± 1039 | 60 | — | 160 ± 173 |
| 10 μg rNS3 | 0.1 | 4 | 360 | <60 | <60 | 60 |
| 10 μg rNS3 | 0.1 | 5 | 60 | <60 | <60 | <60 |
| 10 μg rNS3 | 0.1 | 6 | 2160 | 60 | 60 | 360 |
| | | | 860 ± 1136 | 60 | 60 | 210 ± 212 |
| 10 μg rNS3 | 1.0 | 7 | 2160 | <60 | <60 | 60 |
| 10 μg rNS3 | 1.0 | 8 | 360 | <60 | <60 | <60 |
| 10 μg rNS3 | 1.0 | 9 | 2160 | <60 | <60 | 60 |
| | | Mean | 1560 ± 1039 | — | — | 60 |

The data presented in this example further verify that ribavirin can be administered as an adjuvant and establish that the dose of ribavirin can modulate the kinetics of the adjuvant effect. The example below describes another assay that was performed to evaluate the ability of ribavirin to enhance or facilitate an immune response to an antigen.

Example 13

This assay can be used with any ribavirin derivative or combinations of ribavirin derivatives to determine the extent that a particular vaccine formulation modulates a cellular immune response. To determine CD4+ T cell responses to a ribavirin-containing vaccine, groups of mice were immunized s.c. with either 100 μg rNS3 in PBS or 100 μg rNS3 and 1 mg ribavirin in PBS. The mice were sacrificed ten days post-immunization and their lymph nodes were harvested and drained. In vitro recall assays were then performed. (See e.g., Hultgren et al., *J Gen Virol.* 79:2381-91 (1998) and Hultgren et al., *Clin. Diagn. Lab. Immunol.* 4:630-632 (1997)). The amount of CD4+ T cell proliferation was determined at 96 h of culture by the incorporation of [$^3$H] thymidine.

Figure 9:
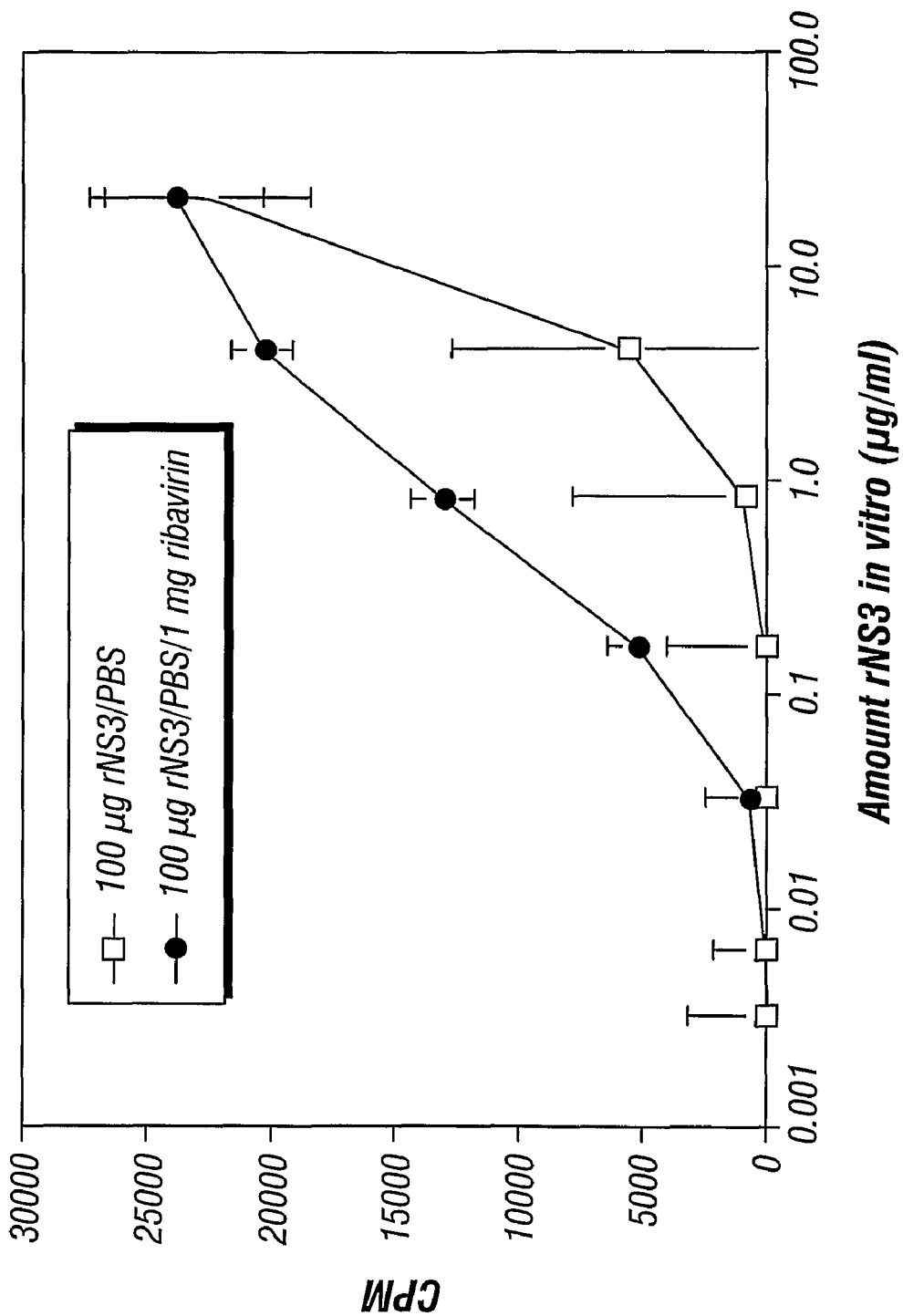

As shown in FIG. 9, mice that were immunized with 100 μg rNS3 mixed with 1 mg ribavirin had a much greater T cell proliferative response than mice that were immunized with 100 μg rNS3 in PBS. This data provides more evidence that ribavirin enhances or facilitates a cellular immune response (e.g., by promoting the effective priming of T cells).

Additional experiments were conducted to verify that ribavirin enhances the immune response to commercially available vaccine preparations. The example below describes the use of ribavirin in conjunction with a commercial HBV vaccine preparation.

Example 14

The adjuvant effect of ribavirin was tested when mixed with two doses of a commercially available vaccine containing HBsAg and alum. (Engerix, SKB). Approximately 0.2 μg or 2 μg of Engerix vaccine was mixed with either PBS or 1 mg ribavirin in PBS and the mixtures were injected intra peritoneally into groups of mice (three per group). A booster containing the same mixture was given on week four and all mice were bled on week six. The serum samples were diluted from 1:60 to 1:37500 and the dilutions were tested by EIA, as described above, except that purified human HBsAg was used as the solid phase antigen. As shown in TABLE 19, vaccine formulations having ribavirin enhanced the response to 2 μg of an existing vaccine despite the fact that the vaccine already contained alum. That is, by adding ribavirin to a suboptimal vaccine dose (i.e., one that does not induce detectable antibodies alone) antibodies became detectable, providing evidence that the addition of ribavirin allows for the use of lower antigen amounts in a vaccine formulation without compromising the immune response.

TABLE 19

| | End point antibody titer to HBsAg in EIA | | | | | | | | | | | |
|---|---|---|---|---|---|---|---|---|---|---|---|---|
| | 0.02 μg Engerix | | | | | | 0.2 μg Engerix | | | | | |
| | No ribavirin | | | 1 mg ribavirin | | | No ribavirin | | | 1 mg ribavirin | | |
| Week | #1 | #2 | #3 | #1 | #2 | #3 | #1 | #2 | #3 | #1 | #2 | #3 |
| 6 | <60 | <60 | <60 | <60 | <60 | <60 | <60 | <60 | <60 | 300 | 60 | <60 |

The ribavirin used in the experiments above was obtained from commercial suppliers (e.g., Sigma and ICN). The ribavirin that can be used with the embodiments described herein can also be obtained from commercial suppliers or can be synthesized. The ribavirin and/or the antigen can be formulated with and without modification. For example, the ribavirin can be modified or derivatized to make a more stable molecule and/or a more potent adjuvant. By one approach, the stability of ribavirin can be enhanced by coupling the molecules to a support such as a hydrophilic polymer (e.g., polyethylene glycol).

Many more ribavirin derivatives can be generated using conventional techniques in rational drug design and combinatorial chemistry. For example, Molecular Simulations Inc. (MSI), as well as many other suppliers, provide software that allows one of skill to build a combinatorial library of organic molecules. The C2.Analog Builder program, for example, can be integrated with MSI's suite of Cerius2 molecular diversity software to develop a library of ribavirin derivatives that can be used with the embodiments described herein. (See e.g., http://msi.com/life/products/cerius2/index.html).

By one approach, the chemical structure of ribavirin is recorded on a computer readable media and is accessed by one or more modeling software application programs. The C2.Analog Builder program in conjunction with C2Diversity program allows the user to generate a very large virtual library based on the diversity of R-groups for each substituent position, for example. Compounds having the same structure as the modeled ribavirin derivatives created in the virtual library are then made using conventional chemistry or can be obtained from a commercial source.

The newly manufactured ribavirin derivatives can then be screened in assays, which determine the extent of adjuvant activity of the molecule and/or the extent of its ability to modulate of an immune response. Some assays may involve virtual drug screening software, such as C2.Ludi. C2.Ludi is a software program that allows a user to explore databases of molecules (e.g., ribavirin derivatives) for their ability to interact with the active site of a protein of interest (e.g., RAC2 or another GTP binding protein). Based upon predicted interactions discovered with the virtual drug screening software, the ribavirin derivatives can be prioritized for further characterization in conventional assays that determine adjuvant activity and/or the extent of a molecule to modulate an immune response. The section below provides more explanation concerning the methods of using the compositions described herein.

Methods of Using the Vaccine Compositions and Immunogen Preparations

Routes of administration of the embodiments described herein include, but are not limited to, transdermal, parenteral, gastrointestinal, transbronchial, and transalveolar. Transdermal administration can be accomplished by application of a cream, rinse, gel, etc. capable of allowing the adjuvant and HCV antigen to penetrate the skin. Parenteral routes of administration include, but are not limited to, electrical or direct injection such as direct injection into a central venous line, intravenous, intramuscular, intraperitoneal, intradermal, or subcutaneous injection. Gastrointestinal routes of administration include, but are not limited to, ingestion and rectal. Transbronchial and transalveolar routes of administration include, but are not limited to, inhalation, either via the mouth or intranasally.

Compositions having the adjuvant and HCV antigen that are suitable for transdermal administration include, but are not limited to, pharmaceutically acceptable suspensions, oils, creams, and ointments applied directly to the skin or incorporated into a protective carrier such as a transdermal device ("transdermal patch"). Examples of suitable creams, ointments, etc. can be found, for instance, in the Physician's Desk Reference. Examples of suitable transdermal devices are described, for instance, in U.S. Pat. No. 4,818,540 issued Apr. 4, 1989 to Chinen, et al.

Compositions having the adjuvant and HCV antigen that are suitable for parenteral administration include, but are not limited to, pharmaceutically acceptable sterile isotonic solutions. Such solutions include, but are not limited to, saline, phosphate buffered saline and oil preparations for injection into a central venous line, intravenous, intramuscular, intraperitoneal, intradermal, or subcutaneous injection.

Compositions having the adjuvant and HCV antigen that are suitable for transbronchial and transalveolar administration include, but not limited to, various types of aerosols for inhalation. Devices suitable for transbronchial and transalveolar administration of these are also embodiments. Such devices include, but are not limited to, atomizers and vaporizers. Many forms of currently available atomizers and vaporizers can be readily adapted to deliver vaccines having ribavirin and an antigen.

Compositions having the adjuvant and HCV antigen that are suitable for gastrointestinal administration include, but not limited to, pharmaceutically acceptable powders, pills or liquids for ingestion and suppositories for rectal administration.

The gene constructs described herein, in particular, may be administered by means including, but not limited to, traditional syringes, needleless injection devices, or "microprojectile bombardment gene guns". Alternatively, the genetic vaccine may be introduced by various means into cells that are removed from the individual. Such means include, for example, ex vivo transfection, electroporation, microinjection and microprojectile bombardment. After the gene construct is taken up by the cells, they are reimplanted into the individual. It is contemplated that otherwise non-immunogenic cells that have gene constructs incorporated therein can be implanted into the individual even if the vaccinated cells were originally taken from another individual.

According to some embodiments, the gene construct is administered to an individual using a needleless injection device. According to some embodiments, the gene construct is simultaneously administered to an individual intradermally, subcutaneously and intramuscularly using a needleless injection device. Needleless injection devices are well known and widely available. One having ordinary skill in the art can, following the teachings herein, use needleless injection devices to deliver genetic material to cells of an individual. Needleless injection devices are well suited to deliver genetic material to all tissue. They are particularly useful to deliver genetic material to skin and muscle cells. In some embodiments, a needleless injection device may be used to propel a liquid that contains DNA molecules toward the surface of the individual's skin. The liquid is propelled at a sufficient velocity such that upon impact with the skin the liquid penetrates the surface of the skin, permeates the skin and muscle tissue therebeneath. Thus, the genetic material is simultaneously administered intradermally, subcutaneously and intramuscularly. In some embodiments, a needleless injection device may be used to deliver genetic material to tissue of other organs in order to introduce a nucleic acid molecule to cells of that organ.

Preferred embodiments concern methods of treating or preventing HCV infection. In these embodiments, an animal in need is provided an HCV antigen (e.g., a peptide antigen or nucleic acid-based antigen, as described herein (SEQ. ID.

NOs.: 1-27, 35-36, and 40-220 (including wild-type and codon optimized sequences encoding SEQ ID NOs: 40-220) and an amount of adjuvant sufficient to exhibit an adjuvant activity in said animal. Accordingly, an animal can be identified as one in need by using currently available diagnostic testing or clinical evaluation. The adjuvant and antigen can be provided separately or in combination, and other adjuvants (e.g., oil, alum, or other agents that enhance an immune response) can also be provided to the animal in need.

Other embodiments of the invention include methods of enhancing an immune response to an HCV antigen by providing an animal in need with an amount of adjuvant (e.g., ribavirin) and one or more of SEQ. ID. NOs.: 1-11, 35-36, and 40-220 (or a wild type or codon-optimized nucleic acid encoding SEQ ID NOs: 40-220) or a fragment thereof, preferably SEQ. ID. NOs.: 12-27 that is effective to enhance said immune response. In these embodiments, an animal in need of an enhanced immune response to an antigen is identified by using currently available diagnostic testing or clinical evaluation. By one approach, for example, an uninfected individual is provided with the vaccine compositions described above in an amount sufficient to elicit a cellular and humoral immune response to NS3 so as to protect said individual from becoming infected with HCV. In another embodiment, an HCV-infected individual is identified and provided with a vaccine composition comprising ribavirin and NS3 in an amount sufficient to enhance the cellular and humoral immune response against NS3 so as to reduce or eliminate the HCV infection. Such individual may be in the chronic or acute phase of the infection. In yet another embodiment, an HCV-infected individual suffering from HCC is provided with a composition comprising an adjuvant and the NS3/4A fusion gene in an amount sufficient to elicit a cellular and humoral immune response against NS3-expressing tumor cells. The isolation and characterization of novel NS3/NS4A polypeptides that have altered protease activity is described in the following example.

Example 15

The serine protease cleavage domain of NS3/NS4A resides in the first 181 amino acids of the peptide (Lin, C. et al., J. Virol., 68(12):8147-8157 (1994)). FIG. 17 depicts the amino acid sequence of the protease cleavage domain of the NS3/NS4A polypeptide from HCV isolate disclosed herein (SEQ ID NO: 39). To identify amino acid residues that affect protease activity in the HCV isolate, mutations were made in each of the 181 amino acids of the protease cleavage domain. Briefly, the NS3/NS4A-pVAX plasmid (described in Example 1) was used as a template for site-directed mutageneis using the QUICKCHANGE™ mutagenesis kit (Stratagene), following the manufacturer's recommendations. Using this approach, NS3/NS4A-pVAX constructs encoding the polypeptides of (SEQ ID NO: 40 through SEQ ID NO: 221) were made. These constructs encode NS3/NS4A polypeptides in which every residue other than alanine in (SEQ ID NO: 39) is changed to an alanine, and where every alanine in (SEQ ID NO: 39) is changed to a glycine. The resulting plasmids were sequenced to verify that the NS3/NS4A-pVAX vectors had been correctly made. Plasmids were grown in competent BL21 E. coli, and subsequently purified using Qiagen DNA purification columns (Qiagen, Hamburg, Germany) according to the manufacturer's instructions. Purified plasmid DNA was dissolved in phosphate buffered saline (PBS).

The resulting plasmids were transcribed and translated in vitro, and the resulting polypeptides were visualized by sodium dodecyl sulfate-polyacrylamide gel electrophoresis (SDS-PAGE). In vitro transcription and translation were performed using the T7 coupled reticulocyte lysate TNT™ system (Promega, Madison, Wis.) according to the manufacturer's instructions. All in vitro translation reactions of the constructs were carried out at 30° C. with $^{35}$S-labeled methionine (Amersham International, Plc, Buckinghamshire, UK). The labeled proteins were separated by 12% SDS-PAGE and visualized by exposure to X-ray film (Hyper Film-MP, Amersham) for 6-18 hours.

When the assay described above is performed with wtNS3/NS4A-pVAX, the protease activity of wtNS3/NS4A protein (SEQ ID NO: 2) is such that two protein bands are visualized on the autorad of the gel: a protein band of approximately 67 kDa, which is consistent with the size of the NS3/NS4A uncleaved protein, and a protein band of approximately 61 kDa, which corresponds to the NS3 cleavage product from the reaction. Each of the 181 mutant NS3/NS4A-pVAX constructs was tested in the assay described above. For each mutant construct assayed, the amount of uncleaved (67 kDa) versus cleaved NS3/NS4A (61 kDa cleavage product) was compared between the wtNS3/NS4A construct and the NS3/NS4A mutant construct, as a measure of how each mutation affected the protease activity. As shown in Table 20, the following NS3/NS4A constructs have amino acid substitutions that completely abolished protease activity: SEQ ID NOs: 87, 92, 96, 120, 124, 130, 136, 138, 162, 163, 178, 179, 184, 192, 208, and 214. In reference to NS3 protease activity, the term "completely abolished" is meant to refer to polypeptides that have less than, equal to, or any number in between about 10%, 9%, 8%, 7%, 6%, 5%, 4%, 3% 2% and 1% of the NS3 protease activity compared to the protease activity of a wild type NS3 polypeptide or NS3/4A polypeptide (e.g., SEQ ID NO:36). In reference to NS3 protease activity, the term "reduced" is meant to refer to polypeptides that have less than, equal to, or any number in between about 100%, 95%, 90%, 85%, 80%, 75%, 70%, 65%, 60%, 55%, 50%, 45%, 40%, 35%, 30%, 25%, 20%, 15% and 10% of the NS3 protease activity compared to the protease activity of a wild type NS3 polypeptide or NS3/4A polypeptide (e.g., SEQ ID NO:36). The following eight constructs have mutations that result in reduced protease activity: SEQ ID NOs: 83, 133, 145, 147, 165, 182, 183, and 188.

As shown in Table 21, twenty two constructs have substitutions that result in enhanced (SEQ ID NOs: 45, 50, 52, 53, 69, 98, 103, 112, 115, 125, 150, 161, 173, 175, 180, 200, 205, and 216), or greatly enhanced protease activity (SEQ ID NOs: 91, 97, and 197). In reference to NS3 protease activity, the term "enhanced" and "greatly enhanced" is meant to refer to polypeptides that have greater than, equal to, or any number in between about 100%, 101%, 105%, 110%, 115%, 120%, 125%, 130%, 135%, 140%, 145%, 150%, 155%, 160%, 165%, 170%, 175%, 180%, 185%, 190%, 195%, 200%, 210%, 220%, 230%, 240%, 250%, 260%, 270%, 280%, 290%, 300%, 310%, 320%, 330%, 340%, 350%, 360%, 370%, 380%, 390%, 400%, 425%, 450%, 475%, 500%, 600% and 700% of the NS3 protease activity compared to the protease activity of a wild type NS3 polypeptide or NS3/4A polypeptide (e.g., SEQ ID NO:36).

TABLE 20

| Leu44Ala (SEQ ID NO: 83) | Reduced |
|---|---|
| Ile48Ala (SEQ ID NO: 87) | Abolished |
| Trp53Ala (SEQ ID NO: 92) | Abolished |
| His57Ala (SEQ ID NO: 96) | Abolished |
| Asp81Ala (SEQ ID NO: 120) | Abolished |

TABLE 20-continued

| | | |
|---|---|---|
| Trp85Ala (SEQ ID NO: 124) | | Abolished |
| Ala91Gly (SEQ ID NO: 130) | | Abolished |
| Leu94Ala (SEQ ID NO: 133) | | Reduced |
| Cys97Ala (SEQ ID NO: 136) | | Abolished |
| Cys99Ala (SEQ ID NO: 138) | | Abolished |
| Leu106Ala (SEQ ID NO: 145) | | Reduced |
| Thr108Ala (SEQ ID NO: 147) | | Reduced |
| Arg123Ala (SEQ ID NO: 162) | | Abolished |
| Gly124Ala (SEQ ID NO: 163) | | Abolished |
| Leu126Ala (SEQ ID NO: 165) | | Reduced |
| Ser139Ala (SEQ ID NO: 178) | | Abolished |
| Gly140Ala (SEQ ID NO: 179) | | Abolished |
| Leu143Ala (SEQ ID NO: 182) | | Reduced |
| Leu144Ala (SEQ ID NO: 183) | | Reduced |
| Cys145Ala (SEQ ID NO: 184) | | Abolished |
| His149Ala (SEQ ID NO: 188) | | Reduced |
| Ile153Ala (SEQ ID NO: 192) | | Abolished |
| Phe169Ala (SEQ ID NO: 208) | | Abolished |
| Leu175Ala (SEQ ID NO: 214) | | Abolished |

TABLE 21

| Mutation | Activity |
|---|---|
| Tyr6Ala (SEQ ID NO: 45) | Enhanced |
| Arg11Ala (SEQ ID NO: 50) | Enhanced |
| Leu13Ala (SEQ ID NO: 52) | Enhanced |
| Leu14Ala (SED ID NO: 53) | Enhanced |
| Glu30Ala (SEQ ID NO: 69) | Enhanced |
| Cys52Ala (SEQ ID NO: 91) | Greatly enhanced |
| Gly58Ala (SEQ ID NO: 97) | Greatly enhanced |
| Ala59Gly (SEQ ID NO: 98) | Enhanced |
| Ile64Ala (SEQ ID NO: 103) | Enhanced |
| Gln73Ala (SEQ ID NO: 112) | Enhanced |
| Thr76Ala (SEQ ID NO: 115) | Enhanced |
| Pro86Ala (SEQ ID NO: 125) | Enhanced |
| Ala111Gly (SEQ ID NO: 150) | Enhanced |
| Gly122Ala (SEQ ID NO: 161) | Enhanced |
| Tyr134Ala (SEQ ID NO: 173) | Enhanced |
| Lys136Ala (SEQ ID NO: 175) | Enhanced |
| Gly141Ala (SEQ ID NO: 180) | Enhanced |
| Val158Ala (SEQ ID NO: 197) | Greatly Enhanced |
| Arg161Ala (SEQ ID NO: 200) | Enhanced |
| Ala166Gly (SEQ ID NO: 205) | Enhanced |
| Thr177Ala (SEQ ID NO: 216) | Enhanced |

Protease activity is associated with viral assembly and maturation (See, e.g., Babe et al., Cell, 91:427-430 (1997)). Accordingly, mutant NS3/NS4A polypeptides with altered protease activity and their encoding nucleic acids are useful in the immunogenic compositions described herein. The fragments listed in TABLES 20-21 are preferred immunogens that can be incorporated with or without an adjuvant (e.g., ribavirin) into a composition for administration to an animal so as to induce an immune response in said animal to HCV.

As shown in TABLE 22, the following NS3/4A constructs have amino acid substitutions that did not have a large effect (SEQ ID NOs: 40, 48-49, 54, 56, 60-61, 66, 72, 74-75, 77-79, 82, 85, 89, 100-102, 107-110, 113-114, 121, 131, 144, 146, 148-149, 152-153, 156, 160, 166, 167, 170-171, 177, 181, 185-186, 189-190, 194-195, 198-199, 204, 206, 209, 210, 213, 215, and 217), or did not have any detectable effect on protease activity (SEQ ID NOs: 41-44, 46, 47, 51, 55, 58, 59, 62, 65, 67-68, 70-71, 73, 76, 80-81, 84, 86, 88, 90, 93, 95, 99, 104-106, 111, 116-119, 123, 127-129, 134-135, 137, 139-143, 151, 154-155, 157-159, 164, 168-169, 172, 176, 191, 193, 196, 201-203, 211-212, and 218-220). The fragments listed in TABLE 22 are preferred immunogens that can be incorporated with or without an adjuvant (e.g., ribavirin) into a composition for administration to an animal so as to induce an immune response in said animal to HCV.

TABLE 22

| Mutation | | Activity |
|---|---|---|
| Ala1Gly | (SEQ ID NO: 40) | Little Effect |
| Pro2Ala | (SEQ ID NO: 41) | No Effect |
| Ile3Ala | (SEQ ID NO: 42) | No Effect |
| Thr4Ala | (SED ID NO: 43) | No Effect |
| Ala5Gly | (SEQ ID NO: 44) | No Effect |
| Ala7Gly | (SEQ ID NO: 46) | No Effect |
| Gln8Ala | (SEQ ID NO: 47) | No Effect |
| Gln9Ala | (SEQ ID NO: 48) | Little Effect |
| Thr10Ala | (SEQ ID NO: 49) | Little Effect |
| Gly12Ala | (SEQ ID NO: 51) | No Effect |
| Gly15Ala | (SEQ ID NO: 54) | Little Effect |
| Cys16Ala | (SEQ ID NO: 55) | No Effect |
| Ile17Ala | (SEQ ID NO: 56) | Little Effect |
| Thr19Ala | (SEQ ID NO: 58) | No Effect |
| Ser20Ala | (SEQ ID NO: 59) | No Effect |
| Leu21Ala | (SEQ ID NO: 60) | Little Effect |
| Thr22Ala | (SEQ ID NO: 61) | Little Effect |
| Gly23Ala | (SEQ ID NO: 62) | No Effect |
| Lys26Ala | (SEQ ID NO: 65) | No Effect |
| Asn27Ala | (SEQ ID NO: 66) | Little Effect |
| Gln28Ala | (SEQ ID NO: 67) | No Effect |
| Val29Ala | (SEQ ID NO: 68) | No Effect |
| Gly31Ala | (SEQ ID NO: 70) | No Effect |
| Glu32Ala | (SEQ ID NO: 71) | No Effect |
| Val33Gly | (SEQ ID NO: 72) | Little Effect |
| Gln34Ala | (SEQ ID NO: 73) | No Effect |
| Ile35Ala | (SEQ ID NO: 74) | Little Effect |
| Val36Ala | (SEQ ID NO: 75) | No Effect |
| Ser37Ala | (SEQ ID NO: 76) | Little Effect |
| Thr38Ala | (SEQ ID NO: 77) | Little Effect |
| Ala39Gly | (SEQ ID NO: 78) | Little Effect |
| Ala40Gly | (SEQ ID NO: 79) | Little Effect |
| Gln41Ala | (SEQ ID NO: 80) | No Effect |
| Thr42Ala | (SEQ ID NO: 81) | No Effect |
| Phe43Ala | (SEQ ID NO: 82) | Little Effect |
| Ala45Gly | (SEQ ID NO: 84) | No Effect |
| Thr46Ala | (SEQ ID NO: 85) | Little Effect |
| Cys47Ala | (SEQ ID NO: 86) | No Effect |
| Gln49Ala | (SEQ ID NO: 88) | No Effect |

TABLE 22-continued

| Mutation | | Activity |
|---|---|---|
| Gly50Ala | (SEQ ID NO: 89) | Little Effect |
| Val51Ala | (SEQ ID NO: 90) | Little Effect |
| Thr54Ala | (SEQ ID NO: 93) | No Effect |
| Arg161Ala | (SEQ ID NO: 95) | No Effect |
| Ala56Gly | (SEQ ID NO: 99) | No Effect |
| Phe57Ala | (SEQ ID NO: 100) | Little Effect |
| Leu58Ala | (SEQ ID NO: 101) | No Effect |
| Thr63Ala | (SEQ ID NO: 102) | Little Effect |
| Thr64Ala | (SEQ ID NO: 103) | No Effect |
| Ala65Gly | (SEQ ID NO: 104) | No Effect |
| Ser66Ala | (SEQ ID NO: 105) | No Effect |
| Pro67Ala | (SEQ ID NO: 106) | No Effect |
| Lys68Ala | (SEQ ID NO: 107) | Little Effect |
| Gly69Ala | (SEQ ID NO: 108) | Little Effect |
| Pro70Ala | (SEQ ID NO: 109) | Little Effect |
| Val71Ala | (SEQ ID NO: 110) | Little Effect |
| Ile72Ala | (SEQ ID NO: 111) | Little Effect |
| Met74Ala | (SEQ ID NO: 113) | Little Effect |
| Tyr75Ala | (SEQ ID NO: 114) | Little Effect |
| Gln77Ala | (SEQ ID NO: 116) | No Effect |
| Val78Ala | (SEQ ID NO: 117) | No Effect |
| Asp79Ala | (SEQ ID NO: 118) | No Effect |
| Gln80Ala | (SEQ ID NO: 119) | No Effect |
| Leu82Ala | (SEQ ID NO: 121) | Little Effect |
| Gly84Ala | (SEQ ID NO: 123) | No Effect |
| Pro88Ala | (SEQ ID NO: 127) | No Effect |
| Gln89Ala | (SEQ ID NO: 128) | No Effect |
| Gly90Ala | (SEQ ID NO: 129) | No Effect |
| Arg92Ala | (SEQ ID NO: 131) | Little Effect |
| Thr95Ala | (SEQ ID NO: 134) | No Effect |
| Pro96Ala | (SEQ ID NO: 135) | No Effect |
| Thr98Ala | (SEQ ID NO: 137) | No Effect |
| Gly100Ala | (SEQ ID NO: 139) | No Effect |
| Ser101Ala | (SEQ ID NO: 140) | No Effect |
| Ser102Ala | (SEQ ID NO: 141) | No Effect |
| Asp103Ala | (SEQ ID NO: 142) | No Effect |
| Leu104Ala | (SEQ ID NO: 143) | No Effect |
| Try105Ala | (SEQ ID NO: 144) | Little Effect |
| Val107Ala | (SEQ ID NO: 146) | Little Effect |
| Arg109Ala | (SEQ ID NO: 148) | Little Effect |
| His110Ala | (SEQ ID NO: 149) | Little Effect |
| Asp112Ala | (SEQ iD NO: 151) | No Effect |
| Val113Ala | (SEQ ID NO: 152) | Little Effect |
| Ile114Ala | (SEQ ID NO: 153) | Little Effect |
| Pro115Ala | (SEQ ID NO: 154) | No Effect |
| Val116Ala | (SEQ ID NO: 155) | No Effect |
| Arg118Ala | (SEQ ID NO: 157) | No Effect |
| Arg119Ala | (SEQ ID NO: 158) | Little Effect |
| Gly120Ala | (SEQ ID NO: 159) | No Effect |
| Asp121Ala | (SEQ ID NO: 160) | Little Effect |
| Ser125Ala | (SEQ ID NO: 164) | No Effect |
| Leu127Ala | (SEQ ID NO: 166) | Little Effect |
| Ser128Ala | (SEQ ID NO: 167) | Little Effect |
| Pro129Ala | (SEQ ID NO: 168) | No Effect |
| Arg130Ala | (SEQ ID NO: 169) | No Effect |
| Pro131Ala | (SEQ ID NO: 170) | Little Effect |
| Ile132Ala | (SEQ ID NO: 171) | Little Effect |
| Ser133Ala | (SEQ ID NO: 172) | No Effect |
| Gly137Ala | (SEQ ID NO: 176) | No Effect |
| Ser138Ala | (SEQ ID NO: 177) | Little Effect |
| Pro142Ala | (SEQ ID NO: 181) | Little Effect |
| Pro146Ala | (SEQ ID NO: 185) | Little Effect |
| Ala147Gly | (SEQ ID NO: 186) | Little Effect |
| Ala150Gly | (SEQ ID NO: 189) | Little Effect |
| Val151Gly | (SEQ ID NO: 190) | Little Effect |
| Gly152Ala | (SEQ ID NO: 191) | No Effect |
| Phe154Ala | (SEQ ID NO: 193) | No Effect |
| Arg155Ala | (SEQ ID NO: 194) | Little Effect |
| Ala156Gly | (SEQ ID NO: 195) | Little Effect |
| Ala157Gly | (SEQ ID NO: 196) | No Effect |
| Cys159Ala | (SEQ ID NO: 198) | Little Effect |
| Thr160Ala | (SEQ ID NO: 199) | Little Effect |
| Gly162Ala | (SEQ ID NO: 201) | No Effect |
| Val163Ala | (SEQ ID NO: 202) | No Effect |
| Ala164Gly | (SEQ ID NO: 203) | No Effect |
| Lys165Ala | (SEQ ID NO: 204) | Little Effect |
| Val167Ala | (SEQ ID NO: 206) | Little Effect |
| Ile170Ala | (SEQ ID NO: 209) | Little Effect |

TABLE 22-continued

| Mutation | | Activity |
|---|---|---|
| Pro171Ala | (SEQ ID NO: 210) | Little Effect |
| Val172Ala | (SEQ ID NO: 211) | No Effect |
| Glu173Ala | (SEQ ID NO: 212) | No Effect |
| Ser174Ala | (SEQ ID NO: 213) | Little Effect |
| Glu176Ala | (SEQ ID NO: 215) | Little Effect |
| Thr178Ala | (SEQ ID NO: 217) | Little Effect |
| Met179Ala | (SEQ ID NO: 218) | No Effect |
| Arg180Ala | (SEQ ID NO: 219) | No Effect |
| Ser181Ala | (SEQ ID NO: 220) | No Effect |

The mutant HCV genes and the encoded polypeptides disclosed herein are useful as novel research tools for drug discovery. Specifically, polypeptides exhibiting enhanced protease activity can be used in assays to identify novel compounds that inhibit protease activity. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

The HCV genes encoding polypeptides with altered protease activity are useful in the creation of transgenic organisms, as described herein. Transgenic organisms expressing mutant HCV polypeptides are useful as model organisms for the study of HCV replication and life cycle.

Although the invention has been described with reference to embodiments and examples, it should be understood that various modifications can be made without departing from the spirit of the invention. Accordingly, the invention is limited only by the following claims.

SEQUENCE LISTING (220 sequences)

SEQ ID NO: 1 - DNA, 2061 bp, Artificial Sequence
  Hepatitis C virus NS3/4A coding region
atggcgcctatcacggcctatgcccagcagacaaggggccttttgggatgcataatcaccagcttgaccggccgggacaaaaaccaggtggagggtgaggttcagatcgtgtcaactgctgcccagactttcttggcaacctgcattaacggggtgtgttggactgtctaccatggagccggaacaaggaccattgcgtcacctaagggtcctgttatccagatgtacaccaatgtggaccaagacctcgtaggctggcccgctccccaaggtgcccgctcattaacaccatgcacttgcggctcctcggacctttacctggtcacgaggcacgccgatgtcattcctgtgcgccgacggggtgatggcaggggcagcctgctttcgccccggcctatctcttacttgaaaggctcctcgggaggccctctgctgtgccccgcaggacatgccgtaggcatattcagagccgcggtatgcacccgtggagtggctaaggcggtggacttcatccccgtagagagcttagagacaaccatgaggtccccggtgttctcagacaactcctccccaccagcagtgccccagagctaccaagtggcccacctgcatgctcccaccggcagcggtaagagcaccaaggtcccggccgcatacgcagctcagggctacaaggtgctggtgctcaacccctccgttgctgcaacaatgggctttggtgcttacatgtccaaggcccatgggattgatcctaacatcaggactggggtgaggacaattactactggcagcccgatcacgtattccacctacggcaagttccttgccgacggcgggtgttcagggggtgcttatgacataataatttgtgacgagtgccactccacggatgcaacatccatcttgggcattggcactgtccttgaccaagcagagaccgcgggggcgagactgactgtgctcgccaccgctacccctccgggctccgtcactgtgccccatcctaacatcgaggaggttgctctgtccactaccggagagatccccttttatggcaaggctattccccttgaagcaattaagggggggagacatctcatcttctgccactcaaagaagaagtgcgacgagctcgccgcaaaactggtcgcgttgggcgtcaatgccgtggcttactaccgcggccttgatgtgtccgtcatcccgaccagtggtgacgttgtcgtcgtggcaactgacgccctcatgaccggctttaccggcgacttcgattcggtgatagactgcaacacgtgtgtcacccagacagtcgacttcagccttgaccctaccttcaccattgagacaatcacgcttccccaggatgctgtctcccgtactcaacgtcggggtaggactggcagagggaagccaggcatctacagatttgtggcaccgggggagcgtccttctggcatgtttgactcgtctgtcctctgcgagtgctatgacgcgggttgtgcttggtatgagcttacgcccgccgagaccacagttaggctacgagcatacatgaacaccccgggacttcccgtgtgccaagaccatcttgaattttgggagggcgtctttacgggtctcacccacatagacgcccacttcctatcccagacaaagcagagtggggaaaaccttccctatctggtagcgtaccaagccaccgtgtgcgctagagctcaagcccctcccccgtcgtgggaccagatgtggaagtgcttgatccgtctcaagcccaccctccatgggccaacacctctgctatatagactgggcgctgtccagaatgaagtcaccctgacgcacccagtcaccaagtatatcatgacatgtatgtcggctgacctggaggtcgtcacgagtacctgggtgctcgttggcggcgttctggctgctttggccgcgtattgcctatccacaggctgcgtggtcatagtaggtaggattgtcttgtccggaaagccggcaatcatacccgacagggaagtcctctaccgggagttcgatgaaatggaagagtgctga

SEQ ID NO: 2 - protein, 686 aa, Artificial Sequence
  Hepatitis C virus NS3/4A peptide
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 3 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTGTWVLVGGVLAALAAYCLSTGCVVIVGRIVLSGKPAIIPDREVLYREFDEMEEC

SEQ ID NO: 4 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRGTWVLVGGVLAALAAYCLSTGCVVIVGRIVLSGKPAIIPDREVLYREFDEMEEC

SEQ ID NO: 5 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTPTWVLVGGVLAALAAYCLSTGCVVIVGRIVLSGKPAIIPDREVLYREFDEMEEC

SEQ ID NO: 6 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRPTWVLVGGVLAALAAYCLSTGCVVIVGRIVLSGKPAIIPDREVLYREFDEMEEC

SEQ ID NO: 7 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRPAWVLVGGVLAALAAYCLSTGCVVIVGRIVLSGKPAIIPDREVLYREFDEMEEC

SEQ ID NO: 8 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVCSTWVLVGGVLAALAAYCLSTGCVVIVGRIVLSGKPAIIPDREVLYREFDEMEEC

SEQ ID NO: 9 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVCCSTWVLVGGVLAALAAYCLSTGCVVIVGRIVLSGKPAIIPDREVLYREFDEMEEC

SEQ ID NO: 10 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVSSSTWVLVGGVLAALAAYCLSTGCVVIVGRIVLSGKPAIIPDREVLYREFDEMEEC

SEQ ID NO: 11 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADSSSSCSTWVLVGGVLAALAAYCLSTGCVVIVGRIVLSGKPAIIPDREVLYREFDEMEEC

SEQ ID NO: 12 - protein, 632 aa, Artificial Sequence
  Hepatitis C virus NS3 peptide
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVT

SEQ ID NO: 13 - protein, 54 aa, Artificial Sequence
  Hepatitis C virus NS4A peptide
STWVLVGGVLAALAAYCLSTGCVVIVGRIVLSGKPAIIPDREVLYREFDEMEEC

SEQ ID NO: 14 - protein, 25 aa, Artificial Sequence
  Hepatitis C virus NS3/4A peptide
TKYMTCMSADLEVVTSTWVLVGGVL

SEQ ID NO: 15 - protein, 12 aa, Artificial Sequence
  Hepatitis C virus NS3/4A peptide
SADLEVVTSTWV

SEQ ID NO: 16 - protein, 25 aa, Artificial Sequence
  Mutant Hepatitis C virus NS3/4A peptide
TKYMTCMSADLEVVTGTWVLVGGVL

SEQ ID NO: 17 - protein, 25 aa, Artificial Sequence
  Mutant Hepatitis C virus NS3/4A peptide
TKYMTCMSADLEVVRGTWVLVGGVL

SEQ ID NO: 18 - protein, 25 aa, Artificial Sequence
  Mutant Hepatitis C virus NS3/4A peptide
TKYMTCMSADLEVVTPTWVLVGGVL

SEQ ID NO: 19 - protein, 25 aa, Artificial Sequence
  Mutant Hepatitis C virus NS3/4A peptide
TKYMTCMSADLEVVRPTWVLVGGVL

SEQ ID NO: 20 - protein, 25 aa, Artificial Sequence
  Mutant Hepatitis C virus NS3/4A peptide
TKYMTCMSADLEVVRPAWVLVGGVL

SEQ ID NO: 21 - protein, 25 aa, Artificial Sequence
  Mutant Hepatitis C virus NS3/4A peptide
TKYMTCMSADLEVVCSTWVLVGGVL

SEQ ID NO: 22 - protein, 25 aa, Artificial Sequence
  Mutant Hepatitis C virus NS3/4A peptide
TKYMTCMSADLEVCCSTWVLVGGVL

SEQ ID NO: 23 - protein, 25 aa, Artificial Sequence
  Mutant Hepatitis C virus NS3/4A peptide
TKYMTCMSADLEVSSSTWVLVGGVL

SEQ ID NO: 24 - protein, 25 aa, Artificial Sequence
  Mutant Hepatitis C virus NS3/4A peptide
TKYMTCMSADSSSSCSTWVLVGGVL

SEQ ID NO: 25 - protein, 25 aa, Artificial Sequence
  Mutant Hepatitis C virus NS3/4A peptide
TKYMTCMSADVVVVTSTWVLVGGVL

SEQ ID NO: 26 - protein, 18 aa, Artificial Sequence
  mutant Hepatitis C virus NS5A/B peptide
SSEDVVCCSMWVLVGGVL

SEQ ID NO: 27 - protein, 16 aa, Artificial Sequence
  Hepatitis C virus NS5 peptide
ASEDVVCCSMSYTWTG

SEQ ID NO: 28 - DNA, 30 bp, Artificial Sequence
  cloning oligonucleotide
ccgtctagatcagcactcttccatttcatc

SEQ ID NO: 29 - DNA, 30 bp, Artificial Sequence
  cloning oligonucleotide
cctgaattcatggcgcctatcacggcctat

SEQ ID NO: 30 - DNA, 24 bp, Artificial Sequence
  cloning oligonucleotide
ccacgcggccgcgacgacctacag

SEQ ID NO: 31 - DNA, 33 bp, Artificial Sequence
  cloning oligonucleotide
ctggaggtcgtcacgcctacctgggtgctcgtt

SEQ ID NO: 32 - DNA, 33 bp, Artificial Sequence
  cloning oligonucleotide
accgagcacccaggtaggcgtgacgacctccag

SEQ ID NO: 33 - DNA, 33 bp, Artificial Sequence
  cloning oligonucleotide
ctggaggtcgtccgcggtacctgggtgctcgtt

SEQ ID NO: 34 - DNA, 33 bp, Artificial Sequence
  cloning oligonucleotide
accgagcacccaggtaccgcggacgacctccag

SEQ ID NO: 35 - DNA, 2078 bp, Artificial Sequence
  Codon optimized hepatitis C virus NS3/4A coding region
  CDS (12)...(2072)
gaattcgcaccatggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgctgatctaga

SEQ ID NO: 36 - protein, 686 aa, Artificial Sequence; identical to SEQ ID NO: 2
  Codon optimized hepatitis c virus NS3/4A coding region

SEQ ID NO: 37 - protein, 9 aa, Artificial Sequence
  Artificial Peptide, NS3/4A H-2D Binding Peptide
GAVQNEVTL

SEQ ID NO: 38 - protein, 9 aa, Artificial Sequence
  Artificial Peptide, H-2D Control Peptide
KAVYNFATM

SEQ ID NO: 39 - protein, 181 aa, Artificial Sequence
  Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRS

SEQ ID NO: 40 - protein, 685 aa, Artificial Sequence
  Mutant Hepatitis C virus NS3/4A peptide
GPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 41 - protein, 685 aa, Artificial Sequence
  Mutant Hepatitis C virus NS3/4A peptide
AAITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 42 - protein, 685 aa, Artificial Sequence
  Mutant Hepatitis C virus NS3/4A peptide
APATAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 43 - protein, 685 aa, Artificial Sequence
  Mutant Hepatitis C virus NS3/4A peptide
APIAAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 44 - protein, 685 aa, Artificial Sequence
  Mutant Hepatitis C virus NS3/4A peptide
APITGYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 45 - protein, 685 aa, Artificial Sequence
  Mutant Hepatitis C virus NS3/4A peptide
APITAAAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 46 - protein, 685 aa, Artificial Sequence
  Mutant Hepatitis C virus NS3/4A peptide
APITAYGQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 47 - protein, 685 aa, Artificial Sequence
  Mutant Hepatitis C virus NS3/4A peptide
APITAYAAQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 48 - protein, 685 aa, Artificial Sequence
  Mutant Hepatitis C virus NS3/4A peptide
APITAYAQATRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 49 - protein, 685 aa, Artificial Sequence
  Mutant Hepatitis C virus NS3/4A peptide
APITAYAQQARGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 50 - protein, 685 aa, Artificial Sequence
  Mutant Hepatitis C virus NS3/4A peptide
APITAYAQQTAGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 51 - protein, 685 aa, Artificial Sequence
  Mutant Hepatitis C virus NS3/4A peptide
APITAYAQQTRALLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 52 - protein, 685 aa, Artificial Sequence
  Mutant Hepatitis C virus NS3/4A peptide
APITAYAQQTRGALGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 53 - protein, 685 aa, Artificial Sequence
  Mutant Hepatitis C virus NS3/4A peptide
APITAYAQQTRGLAGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 54 - protein, 685 aa, Artificial Sequence
  Mutant Hepatitis C virus NS3/4A peptide
APITAYAQQTRGLLACIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 55 - protein, 685 aa, Artificial Sequence
  Mutant Hepatitis C virus NS3/4A peptide
APITAYAQQTRGLLGAIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 56 - protein, 685 aa, Artificial Sequence
  Mutant Hepatitis C virus NS3/4A peptide
APITAYAQQTRGLLGCAITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 57 - protein, 685 aa, Artificial Sequence
  Mutant Hepatitis C virus NS3/4A peptide
APITAYAQQTRGLLGCIATSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 58 - protein, 685 aa, Artificial Sequence
  Mutant Hepatitis C virus NS3/4A peptide
APITAYAQQTRGLLGCIIASLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 59 - protein, 685 aa, Artificial Sequence
  Mutant Hepatitis C virus NS3/4A peptide
APITAYAQQTRGLLGCIITALTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 60 - protein, 685 aa, Artificial Sequence
  Mutant Hepatitis C virus NS3/4A peptide
APITAYAQQTRGLLGCIITSATGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 61 - protein, 685 aa, Artificial Sequence
  Mutant Hepatitis C virus NS3/4A peptide
APITAYAQQTRGLLGCIITSLAGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 62 - protein, 685 aa, Artificial Sequence
  Mutant Hepatitis C virus NS3/4A peptide
APITAYAQQTRGLLGCIITSLTARDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 63 - protein, 685 aa, Artificial Sequence
  Mutant Hepatitis C virus NS3/4A peptide
APITAYAQQTRGLLGCIITSLTGADKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 64 - protein, 685 aa, Artificial Sequence
  Mutant Hepatitis C virus NS3/4A peptide
APITAYAQQTRGLLGCIITSLTGRAKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 65 - protein, 685 aa, Artificial Sequence
  Mutant Hepatitis C virus NS3/4A peptide
APITAYAQQTRGLLGCIITSLTGRDANQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 66 - protein, 685 aa, Artificial Sequence
  Mutant Hepatitis C virus NS3/4A peptide
APITAYAQQTRGLLGCIITSLTGRDKAQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 67 - protein, 685 aa, Artificial Sequence
  Mutant Hepatitis C virus NS3/4A peptide
APITAYAQQTRGLLGCIITSLTGRDKNAVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 68 - protein, 685 aa, Artificial Sequence
  Mutant Hepatitis C virus NS3/4A peptide
APITAYAQQTRGLLGCIITSLTGRDKNQAEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 69 - protein, 685 aa, Artificial Sequence
  Mutant Hepatitis C virus NS3/4A peptide
APITAYAQQTRGLLGCIITSLTGRDKNQVAGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 70 - protein, 685 aa, Artificial Sequence
  Mutant Hepatitis C virus NS3/4A peptide
APITAYAQQTRGLLGCIITSLTGRDKNQVEAEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 71 - protein, 685 aa, Artificial Sequence
  Mutant Hepatitis C virus NS3/4A peptide
APITAYAQQTRGLLGCIITSLTGRDKNQVEGAVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 72 - protein, 685 aa, Artificial Sequence
  Mutant Hepatitis C virus NS3/4A peptide
APITAYAQQTRGLLGCIITSLTGRDKNQVEGEAQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 73 - protein, 685 aa, Artificial Sequence
  Mutant Hepatitis C virus NS3/4A peptide
APITAYAQQTRGLLGCIITSLTGRDKNQVEGEVAIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 74 - protein, 685 aa, Artificial Sequence
  Mutant Hepatitis C virus NS3/4A peptide
APITAYAQQTRGLLGCIITSLTGRDKNQVEGEVQAVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 75 - protein, 685 aa, Artificial Sequence
  Mutant Hepatitis C virus NS3/4A peptide
APITAYAQQTRGLLGCIITSLTGRDKNQVEGEVQIASTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 76 - protein, 685 aa, Artificial Sequence
  Mutant Hepatitis C virus NS3/4A peptide
APITAYAQQTRGLLGCIITSLTGRDKNQVEGEVQIVATAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 77 - protein, 685 aa, Artificial Sequence
  Mutant Hepatitis C virus NS3/4A peptide
APITAYAQQTRGLLGCIITSLTGRDKNQVEGEVQIVSAAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 78 - protein, 685 aa, Artificial Sequence
  Mutant Hepatitis C virus NS3/4A peptide
APITAYAQQTRGLLGCIITSLTGRDKNQVEGEVQIVSTGAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 79 - protein, 685 aa, Artificial Sequence
  Mutant Hepatitis C virus NS3/4A peptide
APITAYAQQTRGLLGCIITSLTGRDKNQVEGEVQIVSTAGQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 80 - protein, 685 aa, Artificial Sequence
  Mutant Hepatitis C virus NS3/4A peptide
APITAYAQQTRGLLGCIITSLTGRDKNQVEGEVQIVSTAAATFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 81 - protein, 685 aa, Artificial Sequence
  Mutant Hepatitis C virus NS3/4A peptide
APITAYAQQTRGLLGCIITSLTGRDKNQVEGEVQIVSTAAQAFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 82 - protein, 685 aa, Artificial Sequence
  Mutant Hepatitis C virus NS3/4A peptide
APITAYAQQTRGLLGCIITSLTGRDKNQVEGEVQIVSTAAQTALATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 83 - protein, 685 aa, Artificial Sequence
  Mutant Hepatitis C virus NS3/4A peptide
APITAYAQQTRGLLGCIITSLTGRDKNQVEGEVQIVSTAAQTFAATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 84 - protein, 685 aa, Artificial Sequence
  Mutant Hepatitis C virus NS3/4A peptide
APITAYAQQTRGLLGCIITSLTGRDKNQVEGEVQIVSTAAQTFLGTCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 85 - protein, 685 aa, Artificial Sequence
  Mutant Hepatitis C virus NS3/4A peptide
APITAYAQQTRGLLGCIITSLTGRDKNQVEGEVQIVSTAAQTFLAACINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 86 - protein, 685 aa, Artificial Sequence
  Mutant Hepatitis C virus NS3/4A peptide
APITAYAQQTRGLLGCIITSLTGRDKNQVEGEVQIVSTAAQTFLATAINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 87 - protein, 685 aa, Artificial Sequence
  Mutant Hepatitis C virus NS3/4A peptide
APITAYAQQTRGLLGCIITSLTGRDKNQVEGEVQIVSTAAQTFLATCANGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 88 - protein, 685 aa, Artificial Sequence
  Mutant Hepatitis C virus NS3/4A peptide
APITAYAQQTRGLLGCIITSLTGRDKNQVEGEVQIVSTAAQTFLATCIAGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 89 - protein, 685 aa, Artificial Sequence
  Mutant Hepatitis C virus NS3/4A peptide
APITAYAQQTRGLLGCIITSLTGRDKNQVEGEVQIVSTAAQTFLATCINAVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 90 - protein, 685 aa, Artificial Sequence
  Mutant Hepatitis C virus NS3/4A peptide
APITAYAQQTRGLLGCIITSLTGRDKNQVEGEVQIVSTAAQTFLATCINGACWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 91 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVAWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 92 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCATVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 93 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWAVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 94 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTAYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 95 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVAHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 96 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYAGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 97 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHAAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 98 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGGGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 99 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAATRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 100 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGARTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 101 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTATIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 102 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRAIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 103 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTAASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 104 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIGSPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 105 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIAAPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 106 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASAKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 107 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPAGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 108 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKAPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 109 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGAVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 110 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPAIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 111 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVAQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 112 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIAMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 113 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQAYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 114 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMATNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 115 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYANVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 116 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTAVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 117 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNADQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 118 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVAQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 119 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDADLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 120 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQALVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 121 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDAVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 122 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLAGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 123 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVAWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 124 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGAPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 125 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWAAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 126 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPGPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 127 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAAQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 128 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPAGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 129 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQAARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 130 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGGRSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 131 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGAASLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 132 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARALTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 133 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSATPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 134 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLAPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 135 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTACTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 136 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPATCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 137 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCACGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 138 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTAGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 139 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCASSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 140 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGASDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 141 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSADLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 142 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSALYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 143 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDAYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 144 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLALVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 145 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYAVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 146 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLATRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 147 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVARHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 148 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTAHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 149 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRAADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 150 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHGDVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 151 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHAAVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 152 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADAIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 153 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVAPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 154 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIAVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 155 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPARRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 156 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVARRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 157 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRARGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 158 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRAGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 159 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRADGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 160 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGAGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 161 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDARGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 162 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGAGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 163 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRASLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 164 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGALLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 165 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSALSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 166 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLASPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 167 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLAPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 168 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSARPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 169 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPAPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 170 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRAISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 171 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPASYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 172 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPIAYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 173 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISALKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 174 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYAKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 175 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLAGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 176 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKASSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 177 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGASGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 178 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSAGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 179 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSAGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 180 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGAPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 181 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGALLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 182 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPALCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 183 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLACPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 184 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLAPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 185 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCAAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 186 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPGGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 187 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAAHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 188 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGAAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 189 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHGVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 190 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAAGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 191 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVAIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 192 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGAFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 193 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIARAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 194 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFAAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 195 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRGAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 196 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAGVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 197 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAACTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 198 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVATRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 199 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCARGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 200 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTAGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 201 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRAVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 202 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGAAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 203 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVGKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 204 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAAAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 205 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKGVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 206 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAADFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 207 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVAFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 208 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDAIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 209 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFAPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 210 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIAVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 211 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPAESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 212 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVASLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 213 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVEALETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 214 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESAETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 215 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLATTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 216 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLEATMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 217 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETAMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 218 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTARSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 219 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMASPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 220 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRAPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

What is claimed is:

1. A purified or isolated nucleic acid encoding a polypeptide comprising an NS3/NS4A polypeptide with enhanced protease activity, wherein said NS3/4A polypeptide is selected from the group consisting of SEQ ID NO: 45, SEQ ID NO: 50, SEQ ID NO: 52, SEQ ID NO: 53, SEQ ID NO: 69, SEQ ID NO: 91, SEQ ID NO: 97, SEQ ID NO: 98, SEQ ID NO: 103, SEQ ID NO: 112, SEQ ID NO: 115, SEQ ID NO: 125, SEQ ID NO: 150, SEQ ID NO: 161, SEQ ID NO: 173, SEQ ID NO: 175, SEQ ID NO: 180, SEQ ID NO: 197, SEQ ID NO: 200, SEQ ID NO: 205, and SEQ ID NO: 216.

2. The purified or isolated nucleic acid of claim 1, wherein said NS3/NS4A polypeptide is SEQ ID NO: 45.

3. The purified or isolated nucleic acid of claim 1, wherein said NS3/NS4A polypeptide is SEQ ID NO: 50.

4. The purified or isolated nucleic acid of claim 1, wherein said NS3/NS4A polypeptide is SEQ ID NO: 52.

5. The purified or isolated nucleic acid of claim 1, wherein said NS3/NS4A polypeptide is SEQ ID NO: 53.

6. The purified or isolated nucleic acid of claim 1, wherein said NS3/NS4A polypeptide is SEQ ID NO: 69.

7. The purified or isolated nucleic acid of claim 1, wherein said NS3/NS4A polypeptide is SEQ ID NO: 91.

8. The purified or isolated nucleic acid of claim 1, wherein said NS3/NS4A polypeptide is SEQ ID NO: 97.

9. The purified or isolated nucleic acid of claim 1, wherein said NS3/NS4A polypeptide is SEQ ID NO: 98.

10. The purified or isolated nucleic acid of claim 1, wherein said NS3/NS4A polypeptide is SEQ ID NO: 103.

11. The purified or isolated nucleic acid of claim 1, wherein said NS3/NS4A polypeptide is SEQ ID NO: 112.

12. The purified or isolated nucleic acid of claim 1, wherein said NS3/NS4A polypeptide is SEQ ID NO: 115.

13. The purified or isolated nucleic acid of claim 1, wherein said NS3/NS4A polypeptide is SEQ ID NO: 125.

14. The purified or isolated nucleic acid of claim 1, wherein said NS3/NS4A polypeptide is SEQ ID NO: 150.

15. The purified or isolated nucleic acid of claim 1, wherein said NS3/NS4A polypeptide is SEQ ID NO: 161.

16. The purified or isolated nucleic acid of claim 1, wherein said NS3/NS4A polypeptide is SEQ ID NO: 173.

17. The purified or isolated nucleic acid of claim 1, wherein said NS3/NS4A polypeptide is SEQ ID NO: 175.

18. The purified or isolated nucleic acid of claim 1, wherein said NS3/NS4A polypeptide is SEQ ID NO: 180.

19. The purified or isolated nucleic acid of claim 1, wherein said NS3/NS4A polypeptide is SEQ ID NO: 197.

20. The purified or isolated nucleic acid of claim 1, wherein said NS3/NS4A polypeptide is SEQ ID NO: 200.

21. The purified or isolated nucleic acid of claim 1, wherein said NS3/NS4A polypeptide is SEQ ID NO: 205.

22. The purified or isolated nucleic acid of claim 1, wherein said NS3/NS4A polypeptide is SEQ ID NO: 216.

* * * * *